(12) United States Patent
Garfall et al.

(10) Patent No.: US 11,747,346 B2
(45) Date of Patent: Sep. 5, 2023

(54) BIOMARKERS PREDICTIVE OF CYTOKINE RELEASE SYNDROME

(71) Applicants: The Trustees of the University of Pennsylvania, Philadelphia, PA (US); Alfred Garfall, Wallingford, PA (US); Alex Ganetsky, Philadelphia, PA (US); Saar Gill, Philadelphia, PA (US); Simon Lacey, Media, PA (US); Jan J. Melenhorst, Cherry Hill, NJ (US); David Teachey, Rutledge, PA (US)

(72) Inventors: Alfred Garfall, Wallingford, PA (US); Alex Ganetsky, Philadelphia, PA (US); Saar Gill, Philadelphia, PA (US); Simon Lacey, Media, PA (US); Jan J. Melenhorst, Moreland Hills, OH (US); David Teachey, Rutledge, PA (US); Eric Lancaster, Wynnewood, PA (US); Adam David Cohen, Bala Cynwyd, PA (US); Pamela Shaw, Seattle, WA (US)

(73) Assignees: Novartis AG, Basel (CH); The Trustees of the University of Pennsylvania, Philadelphia, PA (US)

( * ) Notice: Subject to any disclaimer, the term of this patent is extended or adjusted under 35 U.S.C. 154(b) by 466 days.

(21) Appl. No.: 15/757,123

(22) PCT Filed: Sep. 2, 2016

(86) PCT No.: PCT/US2016/050112
§ 371 (c)(1),
(2) Date: Mar. 2, 2018

(87) PCT Pub. No.: WO2017/040930
PCT Pub. Date: Mar. 9, 2017

(65) Prior Publication Data
US 2018/0252727 A1 Sep. 6, 2018

Related U.S. Application Data

(60) Provisional application No. 62/381,153, filed on Aug. 30, 2016, provisional application No. 62/263,235, filed on Dec. 4, 2015, provisional application No. 62/214,066, filed on Sep. 3, 2015.

(51) Int. Cl.
| | |
|---|---|
| *G01N 33/53* | (2006.01) |
| *G01N 33/68* | (2006.01) |
| *G01N 33/50* | (2006.01) |
| *A61P 37/00* | (2006.01) |
| *A61P 29/00* | (2006.01) |
| *A61K 31/675* | (2006.01) |
| *A61K 35/17* | (2015.01) |
| *A61K 39/395* | (2006.01) |
| *A61K 45/06* | (2006.01) |
| *C07K 14/725* | (2006.01) |
| *C07K 14/705* | (2006.01) |
| *C07K 16/28* | (2006.01) |
| *C12Q 1/6876* | (2018.01) |

(52) U.S. Cl.
CPC ....... *G01N 33/6863* (2013.01); *A61K 31/675* (2013.01); *A61K 35/17* (2013.01); *A61K 39/3955* (2013.01); *A61K 45/06* (2013.01); *A61P 29/00* (2018.01); *A61P 37/00* (2018.01); *C07K 14/7051* (2013.01); *C07K 14/70578* (2013.01); *C07K 16/2803* (2013.01); *C12Q 1/6876* (2013.01); *G01N 33/5047* (2013.01); *G01N 33/6866* (2013.01); *G01N 33/6869* (2013.01); *G01N 33/6893* (2013.01); *C07K 2317/622* (2013.01); *C07K 2317/76* (2013.01); *C07K 2319/02* (2013.01); *C07K 2319/03* (2013.01); *C12Q 2600/106* (2013.01); *C12Q 2600/158* (2013.01); *G01N 2800/24* (2013.01); *G01N 2800/50* (2013.01); *G01N 2800/52* (2013.01); *G01N 2800/7095* (2013.01)

(58) Field of Classification Search
CPC combination set(s) only.
See application file for complete search history.

(56) References Cited

U.S. PATENT DOCUMENTS

| | | |
|---|---|---|
| 5,359,046 A | 10/1994 | Capon et al. |
| 5,686,281 A | 11/1997 | Roberts |
| 5,712,149 A | 1/1998 | Roberts |
| 5,874,240 A | 2/1999 | Ni et al. |
| 5,906,936 A | 5/1999 | Eshhar et al. |
| 6,103,521 A | 8/2000 | Capon et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |

(Continued)

FOREIGN PATENT DOCUMENTS

| | | |
|---|---|---|
| CA | 2878928 A1 | 1/2014 |
| CN | 102539745 A | 7/2012 |

(Continued)

OTHER PUBLICATIONS

Teachey et al, Inflammation Research, 64:2 S237, Aug. 2015.*

(Continued)

*Primary Examiner* — Mark Halvorson
(74) *Attorney, Agent, or Firm* — K&L Gates LLP

(57) ABSTRACT

The present disclosure relates to the identification and use of biomarkers (e.g., analytes, analyte profiles, or markers (e.g., gene expression and/or protein expression profiles)) with clinical relevance to cytokine release syndrome (CRS).

25 Claims, 23 Drawing Sheets
Specification includes a Sequence Listing.

(56) References Cited

U.S. PATENT DOCUMENTS

| | | |
|---|---|---|
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,265,209 B2 | 9/2007 | Jensen |
| 7,319,143 B2 | 1/2008 | Gross et al. |
| 7,320,787 B2 | 1/2008 | Seed et al. |
| 7,446,190 B2 | 11/2008 | Sadelain et al. |
| 7,446,191 B2 | 11/2008 | Jensen |
| 7,514,537 B2 | 4/2009 | Jensen |
| 7,638,326 B2 | 12/2009 | June et al. |
| 7,741,465 B1 | 6/2010 | Eshhar et al. |
| 7,745,140 B2 | 6/2010 | June et al. |
| 7,754,482 B2 | 7/2010 | Riley et al. |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,394,368 B2 | 7/2016 | Brogdon et al. |
| 9,573,988 B2 | 2/2017 | Brogdon et al. |
| 9,745,368 B2 | 8/2017 | Milone et al. |
| 9,777,061 B2 | 10/2017 | Ebersbach et al. |
| 9,815,901 B2 | 11/2017 | Brogdon et al. |
| 2003/0060444 A1 | 3/2003 | Finney et al. |
| 2003/0077249 A1 | 4/2003 | Bebbington et al. |
| 2003/0147869 A1 | 8/2003 | Riley et al. |
| 2003/0148982 A1 | 8/2003 | Brenner et al. |
| 2003/0224520 A1 | 12/2003 | June et al. |
| 2004/0038886 A1 | 2/2004 | Finney et al. |
| 2004/0043401 A1 | 3/2004 | Sadelain et al. |
| 2004/0101519 A1 | 5/2004 | June et al. |
| 2004/0110290 A1 | 6/2004 | June et al. |
| 2005/0113564 A1 | 5/2005 | Campana et al. |
| 2005/0129671 A1 | 6/2005 | Cooper et al. |
| 2006/0034810 A1 | 2/2006 | Riley et al. |
| 2007/0036773 A1 | 2/2007 | Cooper et al. |
| 2008/0131415 A1 | 6/2008 | Riddell et al. |
| 2009/0257994 A1 | 10/2009 | Jensen |
| 2010/0261269 A1 | 10/2010 | June et al. |
| 2011/0052554 A1 | 3/2011 | Zakrzewski et al. |
| 2011/0262467 A1 | 10/2011 | Riley et al. |
| 2012/0148552 A1 | 6/2012 | Jensen |
| 2012/0321667 A1 | 12/2012 | Sentman |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0287748 A1 | 10/2013 | June et al. |
| 2013/0288368 A1 | 10/2013 | June et al. |
| 2013/0309258 A1 | 11/2013 | June et al. |
| 2014/0018446 A1* | 1/2014 | Royall ............... G01N 33/6896 514/789 |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0370017 A1 | 12/2014 | June et al. |
| 2014/0370045 A1 | 12/2014 | June et al. |
| 2015/0017141 A1 | 1/2015 | June et al. |
| 2015/0024482 A1 | 1/2015 | Frigault et al. |
| 2015/0050729 A1 | 2/2015 | June et al. |
| 2015/0093822 A1 | 4/2015 | June et al. |
| 2015/0099299 A1 | 4/2015 | June et al. |
| 2015/0118202 A1 | 4/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0137783 A1 | 5/2017 | Bedoya et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0260268 A1 | 9/2017 | Beatty et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |
| 2018/0044424 A1 | 2/2018 | June et al. |
| 2018/0118834 A1 | 5/2018 | Brogdon et al. |
| 2018/0125892 A1 | 5/2018 | Brannetti et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0258149 A1 | 9/2018 | Motz et al. |
| 2018/0298068 A1 | 10/2018 | Albelda |
| 2018/0312595 A1 | 11/2018 | Brogdon et al. |
| 2019/0000880 A1 | 1/2019 | Motz et al. |
| 2019/0000944 A1 | 1/2019 | Brogdon et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |
| 2019/0263914 A1 | 8/2019 | Brogdon et al. |
| 2019/0269727 A1 | 9/2019 | Fachin et al. |
| 2019/0292238 A1 | 9/2019 | Bitter et al. |
| 2019/0292257 A1 | 9/2019 | Bedoya et al. |
| 2019/0298715 A1 | 10/2019 | Motz et al. |
| 2019/0330356 A1 | 10/2019 | Brogdon et al. |
| 2019/0336504 A1 | 11/2019 | Gill et al. |
| 2019/0375815 A1 | 12/2019 | Engels et al. |
| 2019/0382500 A1 | 12/2019 | Abujoub et al. |
| 2019/0388471 A1 | 12/2019 | June et al. |
| 2019/0389928 A1 | 12/2019 | Posey et al. |
| 2020/0048359 A1 | 2/2020 | Albelda et al. |
| 2020/0055948 A1 | 2/2020 | Daley et al. |
| 2020/0061113 A1 | 2/2020 | Kassim et al. |
| 2020/0085869 A1 | 3/2020 | Schuster et al. |
| 2020/0087376 A1 | 3/2020 | Fraietta et al. |
| 2020/0113941 A1 | 4/2020 | Brannetti et al. |
| 2020/0179511 A1 | 6/2020 | Daley et al. |
| 2020/0215171 A1 | 7/2020 | Brogdon et al. |
| 2020/0281973 A1 | 9/2020 | Dranoff |
| 2020/0283729 A1 | 9/2020 | Loew et al. |
| 2020/0291354 A1 | 9/2020 | Johnson et al. |
| 2020/0339704 A1 | 10/2020 | Bradner et al. |
| 2020/0360431 A1 | 11/2020 | Garfall et al. |
| 2020/0368268 A1 | 11/2020 | Johnson et al. |
| 2020/0370012 A1 | 11/2020 | Fraietta et al. |

(56) References Cited

U.S. PATENT DOCUMENTS

| | | |
|---|---|---|
| 2020/0371091 A1 | 11/2020 | Pruteanu-Malinici et al. |
| 2020/0399383 A1 | 12/2020 | Scholler et al. |
| 2021/0002377 A1 | 1/2021 | Brogdon et al. |
| 2021/0047405 A1 | 2/2021 | Nobles et al. |
| 2021/0079073 A1 | 3/2021 | Milone et al. |
| 2021/0087279 A1 | 3/2021 | Engels et al. |
| 2021/0123016 A1 | 4/2021 | Ihry et al. |
| 2021/0139595 A1 | 5/2021 | Ebersbach et al. |
| 2021/0171909 A1 | 6/2021 | Golovina et al. |
| 2021/0172020 A1 | 6/2021 | Bedoya et al. |
| 2021/0177896 A1 | 6/2021 | Porter et al. |
| 2021/0177900 A1 | 6/2021 | Engels et al. |
| 2021/0213063 A1 | 7/2021 | Isaacs et al. |
| 2021/0214459 A1 | 7/2021 | Brock et al. |
| 2021/0220404 A1 | 7/2021 | Abujoub et al. |
| 2021/0246423 A1 | 8/2021 | Bedoya et al. |
| 2021/0284752 A1 | 9/2021 | Brogdon et al. |
| 2021/0317183 A1 | 10/2021 | Zhao et al. |
| 2021/0347851 A1 | 11/2021 | Isaacs et al. |
| 2021/0396739 A1 | 12/2021 | Pruteanu-Malinici et al. |
| 2022/0047633 A1 | 2/2022 | Grupp |
| 2022/0064316 A1 | 3/2022 | Brogdon et al. |
| 2022/0089750 A1 | 3/2022 | June et al. |
| 2022/0152150 A1 | 5/2022 | Koshy et al. |
| 2022/0168389 A1 | 6/2022 | Ghassemi et al. |
| 2022/0195010 A1 | 6/2022 | Bitter et al. |
| 2022/0251152 A1 | 8/2022 | Carbonneau et al. |
| 2022/0364055 A1 | 11/2022 | Treanor et al. |
| 2022/0387486 A1 | 12/2022 | Brannetti et al. |
| 2023/0026049 A1 | 1/2023 | Brogdon et al. |

FOREIGN PATENT DOCUMENTS

| | | |
|---|---|---|
| EP | 0574512 A1 | 12/1993 |
| EP | 0871495 A1 | 10/1998 |
| EP | 1226244 A2 | 7/2002 |
| WO | 1992015322 A1 | 9/1992 |
| WO | 199530014 A1 | 11/1995 |
| WO | 9623814 A1 | 8/1996 |
| WO | 9624671 A1 | 8/1996 |
| WO | 1997015669 A1 | 5/1997 |
| WO | 9723613 A2 | 7/1997 |
| WO | 9818809 A1 | 5/1998 |
| WO | 9900494 A2 | 1/1999 |
| WO | 9957268 A1 | 11/1999 |
| WO | 0014257 A1 | 3/2000 |
| WO | 2002033101 A1 | 4/2002 |
| WO | 02077029 A2 | 10/2002 |
| WO | 02088334 A1 | 11/2002 |
| WO | 2003057171 A2 | 7/2003 |
| WO | 2005019429 A2 | 3/2005 |
| WO | 2005044996 A2 | 5/2005 |
| WO | 2005/118788 A2 | 12/2005 |
| WO | 2006060878 A1 | 6/2006 |
| WO | 2008045437 A2 | 4/2008 |
| WO | 2009091826 A2 | 7/2009 |
| WO | 2010085660 A2 | 7/2010 |
| WO | 2011059836 A2 | 5/2011 |
| WO | 2011097477 A1 | 8/2011 |
| WO | 2012058460 A2 | 5/2012 |
| WO | 2012079000 A2 | 6/2012 |
| WO | 2012082841 A2 | 6/2012 |
| WO | 2012/099973 A2 | 7/2012 |
| WO | 2012127464 A2 | 9/2012 |
| WO | 2012129514 A1 | 9/2012 |
| WO | 2012135854 A2 | 10/2012 |
| WO | 2012138858 A1 | 10/2012 |
| WO | 2013019615 A2 | 2/2013 |
| WO | 2013033626 A2 | 3/2013 |
| WO | 2013040371 A2 | 3/2013 |
| WO | 2013040557 A2 | 3/2013 |
| WO | 2013059593 A1 | 4/2013 |
| WO | 2013/126712 A1 | 8/2013 |
| WO | 2013126729 A1 | 8/2013 |
| WO | 2013126733 A1 | 8/2013 |
| WO | 2014/011984 A1 | 1/2014 |
| WO | 2014/011987 A1 | 1/2014 |
| WO | 2014/011993 A2 | 1/2014 |
| WO | 2014/012001 A2 | 1/2014 |
| WO | 2014011988 A2 | 1/2014 |
| WO | 2014011996 A1 | 1/2014 |
| WO | 2014031687 A1 | 2/2014 |
| WO | 2014039044 A1 | 3/2014 |
| WO | 2014039513 A2 | 3/2014 |
| WO | 2014/055442 A2 | 4/2014 |
| WO | 2014055657 A1 | 4/2014 |
| WO | 2014130635 A1 | 8/2014 |
| WO | 2014/145252 A2 | 9/2014 |
| WO | 2014153270 A1 | 9/2014 |
| WO | 2015090229 A1 | 6/2015 |
| WO | 2015090230 A1 | 6/2015 |
| WO | 2015112626 A1 | 7/2015 |
| WO | 2015/142661 A1 | 9/2015 |
| WO | 2015142675 A2 | 9/2015 |
| WO | 2015157252 A1 | 10/2015 |
| WO | 2015193740 A2 | 12/2015 |
| WO | 2016014501 A1 | 1/2016 |
| WO | 2016014530 A1 | 1/2016 |
| WO | 2016014535 A1 | 1/2016 |
| WO | 2016014553 A1 | 1/2016 |
| WO | 2016014565 A2 | 1/2016 |
| WO | 2016014576 A1 | 1/2016 |
| WO | 2016019300 A1 | 2/2016 |
| WO | 2016025880 A1 | 2/2016 |
| WO | 2016028896 A1 | 2/2016 |
| WO | 2016044605 A1 | 3/2016 |
| WO | 2016/057705 A1 | 4/2016 |
| WO | 2016090034 A2 | 6/2016 |
| WO | 2017040930 A2 | 3/2017 |
| WO | 2017096331 A1 | 6/2017 |
| WO | 2018013918 A2 | 1/2018 |

OTHER PUBLICATIONS

Patel et al, Immunother, 6:675-678, 2014.*
Lee et al. (Blood, 124:188-195, 2014.*
Jones et al Immun, Endoc & Metab Agents in Med Chem, 8:235-246, 2008.*
Yokoto et al, Clin Rev Allergy Immunol, 28:231-237, 2005.*
Mitsuyama et al, Gut, 36:45-49, 1995.*
Michalopoulou et al, Immunol Lett, 94:183-189, 2004.*
Scheller et al, Scand J Immunol, 63:321-329, 2006.*
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al., "Human 4-1BB regulates CD28 co-stimulation to promote Th1 cell responses" Eur. J. Immunol. (1998) vol. 28 pp. 881-890.
Kochenderfer et al, "A Phase I Clinical Trial of Treatment of B-Cell Malignancies with Autologous Anti-Cd19-CAR-Transduced T Cells" BLOOD (2010) vol. 116 No. 21 pp. 1179-1180 & 52nd Annual Meeting of the American-Society-Of-Hematology (ASH); Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 689-702.
Kochenderfer et al., "Eradication of B-lineage cells and regression of lymphoma in a patient treated with autologous T cells genetically-engineered to recognize CD19," Blood 116: 4099-4102 (2010).
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kwon et al., "cDNA sequences of two inducible T-cell genes". Proc. Natl. Acad. Sci. U.S.A. 86(6): 1963-1967 (1989).

(56) References Cited

OTHER PUBLICATIONS

Lamanna et al., "Pentostatin, Cyclophosphamide, and Rutuximab is an Active, Well-Tolerated Regimen for Patients With Previously Treated Chronic Lymphocytic Leukemia" Journal of Clinical Oncology (2008) vol. 24 No. 10 pp. 1575-1581.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18:2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Macallan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).
Maude et al. "Managing Cytokine Release Syndrome Associated with Novel T Cell-Engaging Therapies" Cancer J. (2014) vol. 20, No. 2, pp. 119-122.
McGuinness et al., "Anti-tumor activity of human T cells expressing the CC49-zeta chimeric immune receptor," Hum. Gene Ther. 10: 165-173 (1999).
Milone et al, "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Molina, "A Decade of Rituximab: Improving Survival Outcomes in Non-Hodgkin's Lymphoma" Annu. Rev. Med. (2008) vol. 59 pp. 237-250.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No 4 pp. 825-833.
Partial International Search Report and Invitation to Pay Additional Fees for International Application No. PCT/US2017/042129 dated Nov. 3, 2017.
Patel et al., "Impact of chimeric immune receptor extracellular protein domains on T cell function" Gene Therapy (1999) vol. 6 pp. 412-419.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.
Porter et al., "Chimeric Antigen Receptor Therapy for B-cell Malignancies" Journal of Cancer (2011) vol. 2 pp. 331-332.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Rapoport et al., "Restoration of immunity in lymphopenic individuals with cancer by vaccination and adoptive T-cell transfer" Nature Medicine (2005) vol. 11 No. 11 pp. 1230-1237.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Sebestyen et al., "Human TCR That Incorporate CD3 Induce Highly Preferred Pairing between TCR and Chains following Gene Transfer" Journal of Immunology (2008) vol. 180 pp. 7736-7746.
Shirasu et al., "Functional Design of Chimeric T-Cell Antigen Receptors for Adoptive Immunotherapy of Cancer: Architecture and Outcomes," AntiCancer Res. 32: 2377-2384 (2012).
Singapore Search Report for SG Application No. 11201702895S dated May 9, 2018.
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Teachey et al. "Identification of Predictive Biomarkers for Cytokine Release Syndrome after Chimeric Antigen Receptor T-cell Therapy for Acute Lymphoblastic Leukemia" Cancer Discovery (2016) vol. 6, No. 6, pp. 664-679.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Van Der Stegen et al. "Preclinical In Vivo Modeling of Cytokine Release Syndrome Induced by ErbB-Retargeted Human T Cells: Identifying a Window of Therapeutic Opportunity?" Journal of Immunology (2013) vol. 191, pp. 4589-4598.
Baeksgaard & Sorensen, "Acute tumor lysis syndrome in solid tumors—a case report and review of the literature" Cancer Chemotherapy Pharmacology (2003) vol. 51 pp. 187-192.

(56) References Cited

OTHER PUBLICATIONS

Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor—Chain alone are Insufficient to Prime Resting T Lymphocytes" J. Exp Med. (1995) vol. 181 pp. 1653-1659.
Call & Wucherpfennig, "The T Cell Receptor: Critical Role of the Membrane Environment in Receptor Assembly and Function" Annu. Rev. Immunol. (2005) vol. 23 pp. 101-125.
Carpenito et al. "Control of large, established tumor xenografts with genetically retargeted human T cells containing CD28 and CD137 domains", Proc Natl Acad Sci USA (2009) vol. 106 pp. 3360-3365.
Clark et al. "Discovery and Development of Janus Kinase (JAK) Inhibitors for Inflammatory Diseases" Jounal of Medicinal Chemistry (2014) vol. 57, pp. 5023-5038.
Davila et al. "B Cell Aplasia in a Patient with Relapsed B Cell Acute Lymphoblastic Leukemia Following Re-Induction and Consolidation with Autologous T Cells Genetically Targeted to the CD 19 Antigen" 53rd ASH Annual Meeting and Exposition (2010) Oral and Poster Abstract.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al, "A Third-Generation Lentivirus Vector with a Conditional Packaging System" Journal of Virology (1998) vol. 72 No. 11 pp. 8463-8471.
Epstein et al. "Temporal stability of serum concentrations of cytokines and soluble receptors measured across two years in low-risk HIV seronegative men" Cancer Epidemiol Biomarkers Prev. (2013) vol. 22, No. 11, pp. 1-12.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.

Friedmann-Morvinski et al., "Redirected primary T cells harboring a chimeric receptor require costimulation for their antigen-specific activation," Blood 105: 3087-3093 (2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No 2 pp. 139-151.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
He et al. "Expression Pattern of Serum Cytokines in Hepatitis B Virus Infected Patients with Persistently Normal Alanine Aminotransferase Levels" Journal of Clinical Immunology (2013) vol. 33, pp. 1240-1249.
Hekele et al., "Growth Retardation of Tumors by Adoptive Transfer of Cytotoxic T Lymphocytes Reprogrammed by CD44V6-SPECIFIC SCFV:~-Chimera" Int J. Cancer (1996) vol. 68 pp. 232-238.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD 19 antigen for autologous adoptive cell therapy" J Immunother (2009) vol. 32 No. 2 pp. 169-180.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Imai et al., "Chimeric receptors with 4-1BB signaling capacity provoke potent cytotoxicity against acute lymphoblastic leukemia," Leukemia 18: 676-684 (2004).
Imai et al., "Genetic modification of primary natural killer cells overcomes inhibitory signals and induces specific killing of leukemic cells" Blood (2005) vol. 106 No. 1 pp. 376-383.
International Preliminary Report on Patentability for International Application No. PCT/US2015054542 dated Apr. 11, 2017.
International Search Report and Written Opinion for International Application No. PCT/US2015/054542 dated Mar. 14, 2016.
International Search Report and Written Opinion for International Application No. PCT/US2016/050112 dated Feb. 27, 2017.
International Search Report from PCT/US2011/064191 dated Jan. 5, 2012.
Irving et al., "The cytoplasmic domain of the T cell receptor zeta chain is sufficient to couple to receptor-associated signal transduction pathways," Cell 64: 891-901 (1991).

(56) References Cited

OTHER PUBLICATIONS

Jena, Bipulendu et al. "Redirecting T-cell specificity by introducing a tumor-specific chimeric antigen receptor, Blood, May 3, 2010", vol. 116, No. 7, pp. 1035-1044.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
June et al., "Engineering lymphocyte subsets: tools, trials and tribulations" Nat Rev Immunol (2009) vol. 9 No. 10 pp. 704-716.
Kalos et al. "Adoptive T Cell Transfer for Cancer Immunotherapy in the Era of Synthetic Biology" Immunity (2013) vol. 39, pp. 49-60.
Tockman et al. "Considerations in Bringing a Cancer Biomarker to Clinical Application" Cancer Research (1992) vol. 52, pp. 2711s-2718s.
International Search Report and Written Opinion for International Application No. PCT/US2017/042129 dated Jan. 3, 2018.
Vinay & Kwon, "Role of 4-1BB in immune responses" Immunology (1998) vol. 10 pp. 481-489.
Willemsen et al., "Genetic Engineering of T Cell Specificity for Immunotherapy of Cancer" Human Immunology (2003) vol. 64 pp. 56-68.
Xu et al. "Closely related T-memory stem cells correlate with in vivo expansion of CAR.CD19-T cells and are preserved by IL-7 and IL-15" Blood (2014) vol. 123, No. 24, pp. 3750-3759.
Ye et al. "Programmed death-1 expression is associated with the disease status in hepatitis B virus infection" World Journal of Gastroenterology (2008) vol. 14, No. 28, pp. 4551-4557.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Li et al., "The Significane of Dynamic Monitoring the Levels of Interlutin-11 (IL-11) and Soluble gp130(sgp130) in Peripheral Blood of Patients during Process of Mobilization for Autologus Peripheral Blood Stem Cells Transplantation," Journal of Suzhou Medical Biotechnology Institute (2000) vol. 20, No. 10, pp. 885-887. Chinese with English abstract.
Wang et al., "An analysis on the correlation between sIL-6R and sIL-2R in cerebral bleeding and cerebral infarction patients," Journal of Emergency Medicine (1999) vol. 8, No. 3, pp. 174-176. Chinese with English abstract.
Abaza et al., "Effects of Amino Acid Substitutions Outside an Antigenic Site on Protein Binding to Monoclonal Antibodies of Predetermined Specificity Obtained by Peptide Immunization: Demonstration with Region 94-100 (Antigenic Site 3) of Myoglobin," Journal of Protein Chemistry (1992) vol. 11, No. 5, pp. 443-444.
Ibragimova et al., "Stability of the Beta-Sheet of the WW Domain: A Molecular Dynamics Simulation Study," Biophysical Journal (1999) vol. 77, pp. 2191-2198.
Ouyang et al., "Flow Cytometry Immunophenotypic Analysis of Phailadelphia-Negative Myeloproliferative Neoplasms: Correlation With Histopathologic Features," Cytometry Part B (Clinical Cytometry) (2015) vol. 88B, pp. 236-243.
Prazma et al., "Dendritic cell CD83: A therapeutic target or innocent bystander?" Immunology Letters (2008) vol. 115, pp. 1-8.
Rudikoff et al., "Single amino acid substitution altering antigen-binding specificity," Proc Natl Acad Sci USA (1982) vol. 79, pp. 1979-1983.
Vaddi et al., "Ruxolitinib, an oral JAK1 and JAK2 inhibitor, in myelofibrosis," Expert Opinion on Pharmacotherapy (2012) vol. 13, No. 16, pp. 2397-2407.
Bonini et al., "Adoptive T-cell therapy for cancer: The era of engineered T cells," Eur J Immunol (2015) vol. 45, pp. 2457-2469.
Colman, "Effects of amino acid sequence changes on antibody-antigen interactions" Research in Immunology (1994) vol. 145, No. 1, pp. 33-36.
Tasian et al. "CD19-redirected chimeric antigen receptor-modified T cells: a promising immunotherapy for children and adults with B-cell acute lymphoblastic leukemia (ALL)" Therapeutic Advances in Hematology (2015) vol. 6, No. 5, pp. 228-241.
Gura, "Systems for Identifying New Drugs are Often Faulty," Science (1997) vol. 278, Issue 5340, pp. 1041-1042.
Heine et al., "The JAK-inhibitor ruxolitinib impairs dendritic cell function in vitro and in vivo," Blood (2013) vol. 122, No. 7, pp. 1192-1202.
Kaiser, "First Pass at Cancer Genome Reveals Complex Landscape," Science (2006) vol. 313, pp. 1370-1371.
O'Shea et al., "The JAK-STAT Pathway: Impact on Human Disease and Therapeutic Intervention," Annu Rev Med (2015) vol. 66, pp. 311-328.
Quintas-Cardama et al., "Molecular Pathways: JAK/STAT Pathway: Mutations, Inhibitors, and Resistance," Clin Cancer Res (2013) vol. 19, No. 8, pp. 1933-1940.
Scheller et al., "The pro- and anti-inflammatory properties of the cytokine interleukin-6," Biochimica et Biophysica Acta (2011) vol. 1813, pp. 878-888.
Sinclair et al., "Potency and Selectivity Assessment of Small Molecules Against Janus Kinase (JAK) 2: Widely Used AG490 Inhibitor is Neither Potent Nor Selective for JAK2," Blood (2011) vol. 118, No. 21, Abstract 4780.
[No Author Listed] Affymetrix GeneChip® Human Genome 133 Set Package Insert (2009) 2 pages.
Del Rio et al., "Gene Expression Signature in Advanced Colorectal Cancer Patients Select Srugs and Response for the Use fof Leucovorin, Flurouracil, and Irinotecan," J Clin Oncol (2007) vol. 25, pp. 773-780.
Kuss et al., "Effector CD8+CD45RO-CD27—T cells have signalling defects in patients with squamous cell carcinoma of the head and neck," British Journal of Cancer (2003) vol. 88, pp. 223-230.
Xu Q. et al., "Effect of Ruxolitinib on proliferation and apoptosis in human erythroleukemia leukemia cells," Academic Journal of Second Military Medical University, 2016, Issue 1, pp. 52-58, Chinese with English abstract.

* cited by examiner

BIOMARKERS PREDICTIVE OF CYTOKINE RELEASE SYNDROME

RELATED APPLICATIONS

This application is a U.S. National Phase Application and claims the benefit of priority under 35 U.S.C. § 371 of International Application No. PCT/US2016/050112, filed Sep. 2, 2016, which claims priority to U.S. Ser. No. 62/214,066 filed Sep. 3, 2015, U.S. Ser. No. 62/263,235 filed Dec. 4, 2015, and U.S. Ser. No. 62/381,153 filed Aug. 30, 2016, the contents of which are incorporated herein by reference in their entireties.

STATEMENT REGARDING FEDERALLY SPONSORED RESEARCH OR DEVELOPMENT

This invention was made with government support under grant numbers R01CA165206, R01CA193776, R01CA102646, R01CA116660, and K23GM110496 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Sep. 2, 2016, is named N2067-7096WO_SL.txt and is 702,117 bytes in size.

FIELD OF THE INVENTION

The invention relates to biomarkers predictive of cytokine release syndrome and uses thereof.

BACKGROUND OF THE INVENTION

CAR T cells with anti-CD19 specificity have demonstrated considerable promise against highly refractory hematologic malignancies. Significant clinical responses with complete remission rates as high as 90% have been reported in children with relapsed/refractory ALL treated with CTL019. Marked in vivo CAR T cell proliferation (100 to 100,000×) leads to improved efficacy, but can be associated with adverse advents, including cytokine release syndrome (CRS). CRS is a serious and common adverse side effect of immune cell-based therapies, e.g., CAR T cell treatment. Severe CRS is a potentially life-threatening toxicity.

A need, therefore, exists for developing methods and biomarkers for predicting a patient's risk of developing CRS.

SUMMARY OF THE INVENTION

The disclosure herein is based, at least in part, on the discovery that several biomarkers can accurately predict CRS early on during an immune cell-based therapy, e.g., a CAR T cell treatment (e.g., before a subject becomes critically ill from CRS, e.g., within the first 10, 9, 8, 7, 6, 5, 4, 3, 2, or 1 day(s), or less, of CAR T cell administration). In some embodiments, two cytokines, sgp130 and IFNγ, were strongly associated with development of severe CRS. In embodiments in adult and pediatric subjects, an accurate early prediction of severe CRS could be made using IFN, sgp130, and IL-1Ra. In embodiments in pediatric subjects, an accurate early prediction of severe CRS could be made using IFNγ, IL13, and MIP1α; or using sgp130, IFNγ, and an assessment of disease burden. Accordingly, provided herein are methods, systems and kits for evaluating a subject, e.g., predicting a subject's risk of developing CRS (e.g., severe CRS), as well as methods of treating a subject having a cancer comprising evaluating the subject's risk of developing CRS (e.g., severe CRS). The methods described herein advantageously provide an early and accurate identification (e.g., prediction) of which subjects treated with immune cell (e.g., T cell or NK cell) therapies (e.g., CAR T cells) have a high probability of becoming critically ill from severe CRS. As the prediction can be made prior to subjects becoming ill, the methods herein permit early interventions that can reduce morbidity or mortality. Therefore, the methods, systems and kits described herein using a small number of cytokines and cytokine receptors to predict severity of CRS with both high sensitivity and specificity are useful clinically, and advantageous over current treatment modalities.

Accordingly, in one aspect, the invention features a method of evaluating, e.g., predicting, a subject's risk of developing CRS, e.g., severe CRS. The method includes acquiring a CRS risk status for the subject, e.g., in response to an immune cell based therapy (e.g., a CAR-expressing cell therapy (e.g., a CAR19-expressing cell therapy) or a CD19-depleting therapy), wherein the CRS risk status is indicative of the subject's risk for developing CRS, e.g., severe CRS. In some embodiments, the CRS risk status comprises a measure of one, two, three, four, five, six, seven, eight, nine, ten or more (all) of the following:

(i) the level or activity of soluble gp130 (sgp130) or interferon-gamma (IFN-g), or a combination thereof, in the subject, e.g., in a sample (e.g., a blood sample), e.g., wherein the subject is an adult or pediatric subject;

(ii) the level or activity of sgp130, IFN-gamma, or IL1Ra, or a combination thereof (e.g., a combination of any two or all three of sgp130, IFN-gamma, and IL1Ra), in the subject, e.g., in a sample (e.g., a blood sample), e.g., wherein the subject is an adult or pediatric subject;

(iii) the level or activity of sgp130 or IFN-gamma or a combination thereof, in a sample (e.g., a blood sample), and the level of bone marrow disease in the subject, e.g., wherein the subject is a pediatric subject;

(iv) the level or activity of sgp130, IFN-gamma, or MIP1-alpha, or a combination thereof (e.g., a combination of any two or all three of sgp130, IFN-gamma, and MIP1-alpha), in a sample (e.g., a blood sample), e.g., wherein the subject is a pediatric subject;

(v) the level or activity of sgp130, MCP1, or eotaxin, or a combination thereof (e.g., a combination of any two or all three of sgp130, MCP1, or eotaxin), in the subject, e.g., in a sample (e.g., a blood sample), e.g., wherein the subject is an adult or a pediatric subject;

(vi) the level or activity of IL-2, eotaxin, or sgp130, or a combination thereof (e.g., a combination of any two or all three of IL-2, eotaxin, or sgp130), in the subject, e.g., in a sample (e.g., a blood sample), e.g., wherein the subject is an adult or a pediatric subject;

(vii) the level or activity of IFN-gamma, IL2, or eotaxin, or a combination thereof (e.g., a combination of any two or all three of IFN-gamma, IL2, or eotaxin), in the subject, e.g., in a sample (e.g., a blood sample), e.g., wherein the subject is a pediatric subject;

(viii) the level or activity of IL10 and the level of disease burden in the subject, or a combination thereof in a subject, e.g., in a sample (e.g., a blood sample), e.g., wherein the subject is a pediatric subject;

(ix) the level or activity of IFN-gamma or IL-13, or a combination thereof, in the subject, e.g., wherein the subject is a pediatric subject;

(x) the level or activity of IFN-gamma, IL-13, or MIP1-alpha, or a combination thereof (e.g., a combination of any two or all three of IFN-gamma, IL-13, and MIP1-alpha), in a sample (e.g., a blood sample), e.g., wherein the subject is a pediatric subject; or (xi) the level or activity of IFN-gamma or MIP1-alpha, or a combination thereof, in a sample (e.g., a blood sample), e.g., wherein the subject is a pediatric subject.

In another aspect, the invention features a method of monitoring a subject's risk of developing CRS, e.g., severe CRS, during the course of a therapy (e.g., an immune cell based therapy (e.g., a CAR-expressing cell therapy (e.g., a CAR19-expressing cell therapy) or a CD19-depleting therapy). The method includes acquiring a CRS risk status for the subject, e.g., in response to the therapy (e.g., the immune cell based therapy), wherein the CRS risk status is indicative of the subject's risk for developing CRS, e.g., severe CRS, during the course of the therapy. In some embodiments, the CRS risk status comprises a measure of one, two, three, four, five, six, seven, eight, nine, ten, or more (all) of the following:

(i) the level or activity of soluble gp130 (sgp130) or interferon-gamma (IFN-g), or a combination thereof, in the subject, e.g., in a sample (e.g., a blood sample), e.g., wherein the subject is an adult or pediatric subject;

(ii) the level or activity of sgp130, IFN-gamma, or IL1Ra, or a combination thereof (e.g., a combination of any two or all three of sgp130, IFN-gamma, and IL1Ra), in the subject, e.g., in a sample (e.g., a blood sample), e.g., wherein the subject is an adult or pediatric subject;

(iii) the level or activity of sgp130 or IFN-gamma or a combination thereof, in a sample (e.g., a blood sample), and the level of bone marrow disease in the subject, e.g., wherein the subject is a pediatric subject; or (iv) the level or activity of sgp130, IFN-gamma, or MIP1-alpha, or a combination thereof (e.g., a combination of any two or all three of sgp130, IFN-gamma, and MIP1-alpha), in a sample (e.g., a blood sample), e.g., wherein the subject is a pediatric subject;

(v) the level or activity of sgp130, MCP1, or eotaxin, or a combination thereof (e.g., a combination of any two or all three of sgp130, MCP1, or eotaxin), in the subject, e.g., in a sample (e.g., a blood sample), e.g., wherein the subject is an adult or a pediatric subject;

(vi) the level or activity of IL2, eotaxin, or sgp130, or a combination thereof (e.g., a combination of any two or all three of IL2, eotaxin, or sgp130), in the subject, e.g., in a sample (e.g., a blood sample), e.g., wherein the subject is an adult or a pediatric subject;

(vii) the level or activity of IFN-gamma, IL2, or eotaxin, or a combination thereof (e.g., a combination of any two or all three of IFN-gamma, IL2, or eotaxin), in the subject, e.g., in a sample (e.g., a blood sample), e.g., wherein the subject is a pediatric subject;

(viii) the level or activity of IL10 and the level of disease burden in the subject, or a combination thereof in a subject, e.g., in a sample (e.g., a blood sample), e.g., wherein the subject is a pediatric subject;

(ix) the level or activity of IFN-gamma or IL-13, or a combination thereof, in the subject, e.g., wherein the subject is a pediatric subject;

(x) the level or activity of IFN-gamma, IL-13, or MIP1-alpha, or a combination thereof (e.g., a combination of any two or all three of IFN-gamma, IL-13, and MIP1-alpha), in a sample (e.g., a blood sample), e.g., wherein the subject is a pediatric subject; or (xi) the level or activity of IFN-gamma or MIP1-alpha, or a combination thereof, in a sample (e.g., a blood sample), e.g., wherein the subject is a pediatric subject.

In yet another aspect, the invention features a method for treating a subject having a cancer, e.g., a hematological cancer. The method includes:

administering to the subject a therapeutically effective dose of a CAR-expressing cell therapy, e.g., a CAR19 therapy; and acquiring a CRS risk status for the subject, wherein said CRS risk status comprises a measure of one, two, three, four, five, six, seven, eight, nine, ten, or more (all) of the following:

(i) the level or activity of sgp130 or IFN-gamma or a combination thereof, in the subject, e.g., in a sample (e.g., a blood sample), e.g., wherein the subject is an adult or pediatric subject;

(ii) the level or activity of sgp130, IFN-gamma, or IL1Ra, or a combination thereof (e.g., a combination of any two or all three of sgp130, IFN-gamma, and IL1Ra), in the subject, e.g., a sample (e.g., a blood sample), e.g., wherein the subject is an adult or pediatric subject;

(iii) the level or activity of sgp130 or IFN-gamma or a combination thereof, in the subject, e.g., in a sample (e.g., a blood sample), and the level of bone marrow disease in the subject, e.g., wherein the subject is a pediatric subject;

(iv) the level or activity of sgp130, IFN-gamma, or MIP1-alpha, or a combination thereof (e.g., a combination of any two or all three of sgp130, IFN-gamma, and MIP1-alpha), in the subject, e.g., in a sample (e.g., a blood sample), e.g., wherein the subject is a pediatric subject, (v) the level or activity of sgp130, MCP1, or eotaxin, or a combination thereof (e.g., a combination of any two or all three of sgp130, MCP1, or eotaxin), in the subject, e.g., in a sample (e.g., a blood sample), e.g., wherein the subject is an adult or a pediatric subject;

(vi) the level or activity of IL-2, eotaxin, or sgp130, or a combination thereof (e.g., a combination of any two or all three of IL-2, eotaxin, or sgp130), in the subject, e.g., in a sample (e.g., a blood sample), e.g., wherein the subject is an adult or a pediatric subject;

(vii) the level or activity of IFN-gamma, IL-2, or eotaxin, or a combination thereof (e.g., a combination of any two or all three of IFN-gamma, IL-2, or eotaxin), in the subject, e.g., in a sample (e.g., a blood sample), e.g., wherein the subject is a pediatric subject;

(viii) the level or activity of IL-10 and the level of disease burden in the subject, or a combination thereof in a subject, e.g., in a sample (e.g., a blood sample), e.g., wherein the subject is a pediatric subject;

(ix) the level or activity of IFN-gamma or IL-13, or a combination thereof, in the subject, e.g., wherein the subject is a pediatric subject; or (x) the level or activity of IFN-gamma, IL-13, or MIP1-alpha, or a combination thereof (e.g., a combination of any two or all three of IFN-gamma, IL-13, and MIP1-alpha), in a sample (e.g., a blood sample), e.g., wherein the subject is a pediatric subject; or (xi) the level or activity of IFN-gamma or MIP1-alpha, or a combination thereof, in a sample (e.g., a blood sample), e.g., wherein the subject is a pediatric subject;

wherein the CRS risk status is indicative of the subject's risk for developing CRS, e.g., severe CRS.

In yet another aspect, the invention features a CAR-expressing cell therapy, e.g., a CAR19 therapy, for use in a subject having a cancer, e.g., a hematological cancer, wherein the subject is identified as having a CRS risk status indicative of the subject's risk for developing CRS, e.g., severe CRS, wherein said CRS risk status comprises a measure of one, two, three, four, five, six, seven, eight, nine, ten, or more (all) of the following:

(i) the level or activity of sgp130 or IFN-gamma or a combination thereof, in the subject, e.g., in a sample (e.g., a blood sample), e.g., wherein the subject is an adult or pediatric subject;

(ii) the level or activity of sgp130, IFN-gamma, or IL1Ra, or a combination thereof (e.g., a combination of any two or all three of sgp130, IFN-gamma, and IL1Ra), in the subject, e.g., a sample (e.g., a blood sample), e.g., wherein the subject is an adult or pediatric subject;

(iii) the level or activity of sgp130 or IFN-gamma or a combination thereof, in the subject, e.g., in a sample (e.g., a blood sample), and the level of bone marrow disease in the subject, e.g., wherein the subject is a pediatric subject;

(iv) the level or activity of sgp130, IFN-gamma, or MIP1-alpha, or a combination thereof (e.g., a combination of any two or all three of sgp130, IFN-gamma, and MIP1-alpha), in the subject, e.g., in a sample (e.g., a blood sample), e.g., wherein the subject is a pediatric subject;

(v) the level or activity of sgp130, MCP1, or eotaxin, or a combination thereof (e.g., a combination of any two or all three of sgp130, MCP1, or eotaxin), in the subject, e.g., in a sample (e.g., a blood sample), e.g., wherein the subject is an adult or a pediatric subject;

(vi) the level or activity of IL2, eotaxin, or sgp130, or a combination thereof (e.g., a combination of any two or all three of IL2, eotaxin, or sgp130), in the subject, e.g., in a sample (e.g., a blood sample), e.g., wherein the subject is an adult or a pediatric subject;

(vii) the level or activity of IFN-gamma, IL2, or eotaxin, or a combination thereof (e.g., a combination of any two or all three of IFN-gamma, IL2, or eotaxin), in the subject, e.g., in a sample (e.g., a blood sample), e.g., wherein the subject is a pediatric subject;

(viii) the level or activity of IL10 and the level of disease burden in the subject, or a combination thereof in a subject, e.g., in a sample (e.g., a blood sample), e.g., wherein the subject is a pediatric subject;

(ix) the level or activity of IFN-gamma or IL-13, or a combination thereof, in the subject, e.g., wherein the subject is a pediatric subject;

(x) the level or activity of IFN-gamma, IL-13, or MIP1-alpha, or a combination thereof (e.g., a combination of any two or all three of IFN-gamma, IL-13, and MIP1-alpha), in a sample (e.g., a blood sample), e.g., wherein the subject is a pediatric subject; or (xi) the level or activity of IFN-gamma or MIP1-alpha, or a combination thereof, in a sample (e.g., a blood sample), e.g., wherein the subject is a pediatric subject.

In yet another aspect, the invention features a system or method for evaluating, e.g., predicting, a subject's risk of developing CRS, e.g., severe CRS. The system includes at least one processor operatively connected to a memory, wherein the at least one processor when executing is configured to acquire a CRS risk status, e.g., in response to an immune cell based therapy (e.g., a CAR-expressing cell therapy (e.g., a CAR19-expressing cell therapy)) for the subject, wherein said CRS risk status comprises (i)-(vii) below. The method includes:

acquiring a CRS risk status for the subject, e.g., in response to an immune cell based therapy (e.g., a CAR-expressing cell therapy (e.g., a CAR19-expressing cell therapy)), wherein said CRS risk status is determined by:

(i) acquiring a sgp130 level or activity;

(ii) if the acquired sgp130 level or activity is below a reference sgp130 level or activity, e.g., of about 218,000 pg/ml, then identifying the CRS risk status as low;

(iii) optionally (e.g., if the acquired sgp130 level or activity is above the reference sgp130 level or activity) acquiring an IFN-gamma level or activity;

(iv) optionally, (e.g., if the acquired sgp130 level or activity is above the reference sgp130 level or activity) if the acquired IFN-gamma level or activity is below a reference IFN-gamma level or activity, e.g., of about 10 pg/ml, then identifying CRS risk status as low;

(v) optionally (e.g., if the acquired IFN-gamma level or activity is above the reference IFN-gamma level or activity) acquiring an IL1Ra level or activity;

(vi) optionally, (e.g., if the acquired IFN-gamma level or activity is above the reference IFN-gamma level or activity) if the acquired IL1Ra level or activity is below a reference IL1Ra level or activity, e.g., of about 658 pg/ml, then identifying the CRS risk status as high; and (vii) optionally, (e.g., if the acquired IFN-gamma level or activity is above the reference IFN-gamma level or activity) if the acquired IL1Ra level or activity is above the reference IL1Ra level or activity, e.g., of about 658 pg/ml, then identifying the CRS risk status as low;

thereby evaluating, e.g., predicting, the subject's risk of developing CRS, e.g., severe CRS.

In yet another aspect, the invention features a system or method for evaluating, e.g., predicting, a subject's risk of developing CRS, e.g., severe CRS. The system includes at least one processor operatively connected to a memory, wherein the at least one processor when executing is configured to acquire a CRS risk status, e.g., in response to an immune cell based therapy (e.g., a CAR-expressing cell therapy (e.g., a CAR19-expressing cell therapy)) for the subject, wherein said CRS risk status comprises (i)-(vii) below. The method includes:

acquiring a CRS risk status for the subject, e.g., in response to an immune cell based therapy (e.g., a CAR-expressing cell therapy (e.g., a CAR19-expressing cell therapy)), wherein said CRS risk status is determined by:

(i) acquiring a sgp130 level or activity;

(ii) if the acquired sgp130 level or activity is below a reference sgp130 level or activity, e.g., of about 218,000 pg/ml, then identifying the CRS risk status as low;

(iii) optionally (e.g., if the acquired sgp130 level or activity is above the reference sgp130 level or activity) acquiring a MCP1 level or activity;

(iv) optionally, (e.g., if the acquired sgp130 level or activity is above the reference sgp130 level or activity) if the acquired MCP1 level or activity is above a reference MCP1 level or activity, e.g., of about 4600 pg/ml, then identifying CRS risk status as high;

(v) optionally (e.g., if the acquired MCP1 level or activity is below the reference MCP1 level or activity) acquiring an eotaxin level or activity;

(vi) optionally, (e.g., if the acquired MCP1 level or activity is below the reference MCP1 level or activity) if the acquired eotaxin level or activity is below a reference eotaxin level or activity, e.g., of about 29 pg/ml, then identifying the CRS risk status as high; and (vii) optionally, (e.g., if the acquired MCP1 level or activity is below the reference MCP1 level or activity) if the acquired eotaxin level or activity is above the reference eotaxin level or activity, e.g., of about 29 pg/ml, then identifying the CRS risk status as low;

thereby evaluating, e.g., predicting, the subject's risk of developing CRS, e.g., severe CRS.

In yet another aspect, the invention features a system or method for evaluating, e.g., predicting, a subject's risk of developing CRS, e.g., severe CRS. The system includes at least one processor operatively connected to a memory, wherein the at least one processor when executing is configured to acquire a CRS risk status, e.g., in response to an immune cell based therapy (e.g., a CAR-expressing cell therapy (e.g., a CAR19-expressing cell therapy)) for the subject, wherein said CRS risk status comprises (i)-(vii) below. The method includes:

acquiring a CRS risk status for the subject, e.g., in response to an immune cell based therapy (e.g., a CAR-expressing cell therapy (e.g., a CAR19-expressing cell therapy)), wherein said CRS risk status is determined by:

(i) acquiring a first IFN-gamma level or activity;

(ii) if the first acquired IFN-gamma level or activity is below a first reference IFN-gamma level or activity, e.g., of about 28 pg/ml, then identifying the CRS risk status as low;

(iii) optionally (e.g., if the first acquired IFN-gamma level or activity is above the first reference IFN-gamma level or activity) acquiring a MIP1a level or activity;

(iv) optionally, (e.g., if the first acquired IFN-gamma level or activity is above the first reference IFN-gamma level or activity) if the acquired MIP1a level or activity is below a reference MIP1a level or activity, e.g., of about 30 pg/ml, then identifying CRS risk status as high;

(v) optionally (e.g., if the acquired MIP1a level or activity is above the reference MIP1a level or activity, or if the step (i) does not yield accurate readings at high values) acquiring a second IFN-gamma level or activity;

(vi) optionally, (e.g., if the acquired MIP1a level or activity is above the reference MIP1a level or activity) if the first acquired IFN-gamma level or activity is below a reference IFN-gamma level or activity, or, optionally, if the second acquired IFN-gamma level or activity is below a reference IFN-gamma level or activity, e.g., of about 95 pg/ml, then identifying the CRS risk status as low; and (vii) optionally, (e.g., if the acquired MIP1a level or activity is above the reference MIP1a level or activity) if the first acquired IFN-gamma level or activity is above a reference IFN-gamma level or activity, or, optionally, if the second acquired IFN-gamma level or activity is above a reference IFN-gamma level or activity, e.g., of about 95 pg/ml, then identifying the CRS risk status as high;

thereby evaluating, e.g., predicting, the subject's risk of developing CRS, e.g., severe CRS.

In yet another aspect, the invention features a system or method for evaluating, e.g., predicting, a subject's risk of developing CRS, e.g., severe CRS. The system includes at least one processor operatively connected to a memory, wherein the at least one processor when executing is configured to acquire a CRS risk status, e.g., in response to an immune cell based therapy (e.g., a CAR-expressing cell therapy (e.g., a CAR19-expressing cell therapy)) for the subject, wherein said CRS risk status comprises (i)-(vii) below. The method includes:

acquiring a CRS risk status for the subject, e.g., in response to an immune cell based therapy (e.g., a CAR-expressing cell therapy (e.g., a CAR19-expressing cell therapy)), wherein said CRS risk status is determined by:

(i) acquiring a first biomarker (e.g., cytokine or cytokine receptor, e.g., cytokine or cytokine receptor described herein) level or activity;

(ii) determining whether the first biomarker level or activity is above or below a first reference level or activity, (iii) optionally acquiring a second biomarker (e.g., cytokine or cytokine receptor, e.g., cytokine or cytokine receptor described herein) level or activity;

(iv) optionally determining whether the second biomarker level or activity is above or below a second reference level or activity, (v) optionally acquiring a third biomarker (e.g., cytokine or cytokine receptor, e.g., cytokine or cytokine receptor described herein) level or activity; and (vi) optionally determining whether the third biomarker level or activity is above or below a third reference level or activity, thereby evaluating, e.g., predicting, the subject's risk of developing CRS, e.g., severe CRS.

In yet another aspect, the invention features a system or method for evaluating, e.g., predicting, a subject's risk of developing CRS, e.g., severe CRS. The system includes at least one processor operatively connected to a memory, wherein the at least one processor when executing is configured to acquire a CRS risk status, e.g., in response to an immune cell based therapy (e.g., a CAR-expressing cell therapy (e.g., a CAR19-expressing cell therapy)) for the subject, wherein said CRS risk status comprises (i)-(vii) below. The method includes:

acquiring a CRS risk status for the subject, e.g., in response to an immune cell based therapy (e.g., a CAR-expressing cell therapy (e.g., a CAR19-expressing cell therapy)), wherein said CRS risk status is determined by:

(i) acquiring an IL-10 level or activity;

(ii) if the acquired IL-10 level or activity is below a reference IL-10 level or activity, e.g., of about 12 pg/ml, then identifying the CRS risk status as low;

(iii) optionally (e.g., if the acquired IL-10 level or activity is above the reference IFN IL-10 level or activity) acquiring a tumor burden level;

(iv) optionally, (e.g., if the acquired IL-10 level or activity is above the reference IL-10 level or activity) if the acquired tumor burden level is below a reference tumor burden level, e.g., of about 51%, then identifying CRS risk status as low;

(v) optionally, (e.g., if the acquired IL-10 level or activity is above the reference IL-10 level or activity) if the acquired tumor burden level is above the reference tumor burden level, e.g., of about 51%, then identifying CRS risk status as high;

thereby evaluating, e.g., predicting, the subject's risk of developing CRS, e.g., severe CRS.

Any of the aforesaid methods can further comprise, responsive to a determination of the CRS risk status, performing one, two, or more (all) of:

identifying the subject as being at high risk of developing severe CRS or at low risk of developing severe CRS;

administering an altered dosing of the CAR-expressing cell therapy;

altering the schedule or time course of the CAR-expressing cell therapy; or administering a therapy to treat CRS, e.g., a therapy chosen from one or more of: an IL-6 inhibitor (e.g., an anti-IL6 receptor inhibitor, e.g., tocilizumab), a vasoactive medication, an immunosuppressive agent, a corticosteroid, or mechanical ventilation; or administering an alternative therapy, e.g., for a subject at high risk of developing severe CRS, e.g., a standard of care for a particular cancer type.

In embodiments of the compositions for use herein, one, two, or more (e.g., all) of:

responsive to a determination of the CRS risk status, the subject is identified as being at high risk of developing severe CRS or at low risk of developing severe CRS;

responsive to a determination of the CRS risk status, the subject is administered an altered dosing of the CAR-expressing cell therapy;

responsive to a determination of the CRS risk status, the schedule or time course of the CAR-expressing cell therapy is altered;

responsive to a determination of the CRS risk status, the subject is administered a therapy to treat CRS, e.g., a therapy chosen from one or more of: an IL-6 inhibitor (e.g., tocilizumab), a vasoactive medication, an immunosuppressive agent, a corticosteroid, or mechanical ventilation; or responsive to a determination of the CRS risk status, the subject is administered an alternative therapy, e.g., for a subject at high risk of developing severe CRS, e.g., a standard of care for a particular cancer type.

In another aspect, the invention features a kit for evaluating, e.g., predicting, a subject's risk of developing CRS, e.g., severe CRS. The kit includes a set of reagents that specifically detects the level or activity of one or more genes or proteins described herein, e.g., chosen from: sgp130 and IFN-gamma; sgp130, IFN-gamma, and IL1Ra; sgp130, IFN-gamma, and MIP1-alpha; sgp130, IFN-gamma, MIP1-alpha, eotaxin, IL-2, IL-10, or IL-13, or a combination thereof; and instructions for using said kit;

wherein said instructions for use provide that if one or more of the detected level or activity is greater than a reference value, the subject is more likely to develop CRS (e.g., severe CRS) than a subject having a detected level or activity at the reference value.

In yet another aspect, the invention features a system for evaluating, e.g., predicting, a subject's risk of developing cytokine release syndrome (CRS), e.g., severe CRS. The system includes at least one processor operatively connected to a memory, wherein the at least one processor when executing is configured to acquire a CRS risk status, e.g., in response to an immune cell based therapy (e.g., a CAR-expressing cell therapy (e.g., a CAR19-expressing cell therapy)) for the subject. In some embodiments, said CRS risk status comprises a measure of one, two, three, four, five, six, seven, or more (all) of the biomarkers described herein.

In some embodiments, responsive to a determination of the CRS risk status, the system performs one, two, three, four or more of:

identify the subject as at high risk of developing severe CRS or at low risk of developing severe CRS;

recommend a selection or alteration of a dosing of a CAR-expressing cell therapy;

recommend a selection or alteration of a schedule or time course of a CAR-expressing cell therapy;

recommend administering a therapy to treat CRS, e.g., an IL-6 inhibitor, such as tocilizumab, a vasoactive medication, an immunosuppressive agent, a corticosteroid, or mechanical ventilation;

recommend a selection of an alternative therapy, e.g., for a severe CRS subject, e.g., a standard of care for a particular cancer type.

Additional features or embodiments of the aforesaid methods, compositions for use, kits and systems disclosed herein include one or more of the following.

In some embodiments of the methods, compositions for use, kits, and systems, the CRS risk status comprises a measure of the level or activity of sgp130, IFN-gamma, or IL-13, or a combination thereof (e.g., a combination of any two or all three of sgp130, IFN-gamma, and IL-13), in the subject, e.g., in a sample (e.g., a blood sample), e.g., wherein the subject is an adult or pediatric subject.

In some embodiments of the methods, compositions for use, kits and systems, the CRS risk status is indicative of whether the subject is at high risk or low risk of developing severe CRS. For example, the CRS can be of clinical grade 1-3, or can be severe CRS of clinical grade 4-5.

In some embodiments, the methods are performed on a subject that does not have a symptom (e.g., a clinical symptom) of CRS, e.g., one or more of low blood pressure or a fever; or severe CRS, e.g., one or more of organ toxicity (e.g., grade 4 organ toxicity) or need for mechanical ventilation.

In some embodiments of the methods, compositions for use, kits and systems, a high level or activity of IFN-gamma, sgp130, MCP1, IL-10, or disease burden, or any combination thereof, is indicative of a high risk of severe CRS. In some embodiments, a low level or activity of IL13, IL1Ra, MIP1a, or eoxtaxin, or any combination thereof, is indicative of a high risk of severe CRS.

In some embodiments of the methods, compositions for use, kits and systems, a subject at high risk of severe CRS has, or is identified as having, a greater level or activity of sgp130 or IFN-gamma or a combination thereof (e.g., in a sample, e.g., a blood sample), e.g., relative to a reference, e.g., compared to a subject at low risk of severe CRS or compared to a control level or activity.

In other embodiments of the methods, compositions for use, kits and systems, a subject at high risk of severe CRS has, or is identified as having a greater level or activity of sgp130, a greater level or activity of IFN-gamma, or a lower level or activity of IL1Ra, or a combination thereof (e.g., in a sample, e.g., a blood sample), e.g., relative to a reference. In one embodiment, the subject at high risk of severe CRS is identified as having a greater level or activity of sgp130 and a greater level or activity of IFN-gamma; a greater level or activity of sgp130 and a lower level or activity of IL1Ra; a greater level or activity of IFN-gamma and a lower level or activity of IL1Ra; or a greater level or activity of sgp130, a greater level or activity of IFN-gamma, and a lower level or activity of IL1Ra, e.g., compared to a reference, e.g., a subject at low risk of severe CRS or a control level or activity. In some embodiments, the reference is a subject at low risk of severe CRS or a control level or activity. The subject can be a human, e.g., an adult or pediatric subject.

In some embodiments of the methods, compositions for use, kits and systems, a subject at high risk of severe CRS has, or is identified as having, a greater level or activity of sgp130 or IFN-gamma or a combination thereof, and a greater level of bone marrow disease, in the subject (e.g., in a sample, e.g., a blood sample), e.g., relative to a reference, e.g., compared to a subject at low risk of severe CRS or compared to a control level or activity. In one embodiment, the subject at high risk of severe CRS is identified as having a greater level of sgp130 and IFN-gamma; sgp130 and bone marrow disease; IFN-gamma and bone marrow disease; or sgp130, IFN-gamma and bone marrow disease, e.g., compared to a reference, e.g., a subject at low risk of severe CRS or a control level or activity. The subject can be a human, e.g., a pediatric subject.

In some embodiments of the methods, compositions for use, kits and systems, a subject (e.g., a pediatric subject) at high risk of severe CRS is identified as having a greater level or activity of sgp130, a greater level or activity of IFN-gamma, or a lower level or activity of MIP1-alpha, or a combination thereof (e.g., in a sample, e.g., a blood sample) compared to a reference, e.g., a subject at low risk of severe CRS or compared to a control level or activity. In one embodiment, a subject at high risk of severe CRS is identified as having a greater level or activity of sgp130 and a greater level or activity of IFN-gamma; a greater level or activity of sgp130 and a lower level or activity of MIP1-alpha; a greater level or activity of IFN-gamma and a lower level or activity of MIP1-alpha; or a greater level or activity of sgp130, a greater level or activity of IFN-gamma, and a lower level or activity of MIP1-alpha, e.g., compared to a reference, e.g., a subject at low risk of severe CRS or compared to a control level or activity.

In some embodiments of the methods, compositions for use, kits and systems, a subject at high risk of severe CRS is identified as having a greater level or activity of sgp130, a greater level or activity of MCP1, or a lower level or activity of eotaxin, or a combination thereof (e.g., in a sample, e.g., a blood sample) compared to a reference, e.g., a subject at low risk of severe CRS or compared to a control level or activity. In some embodiments, a subject at high risk of severe CRS is identified as having: a greater level or activity of sgp130 and a greater level or activity of MCP1; a greater level or activity of sgp130 and a lower level or activity of eotaxin; a greater level or activity of MCP1 and a lower level or activity of eotaxin; or a greater level or activity of sgp130, a greater level or activity of MCP1, and a lower level or activity of eotaxin; compared to a reference, e.g., a subject at low risk of severe CRS or compared to a control level or activity.

In some embodiments of the methods, compositions for use, kits and systems, a subject at high risk of severe CRS is identified as having an altered (e.g., greater) level or activity of IL-2, a lower level or activity of eotaxin, or a greater level or activity of sgp130, or a combination thereof (e.g., in a sample, e.g., a blood sample) compared to a reference, e.g., a subject at low risk of severe CRS or compared to a control level or activity. In some embodiments, a subject at high risk of severe CRS is identified as having: an altered (e.g., greater) level or activity of IL-2 and a lower level or activity of eotaxin; an altered (e.g., greater) level or activity of IL-2 and a greater level or activity of sgp130; a lower level or activity of eotaxin and a greater level or activity of sgp130; or an altered (e.g., greater) level or activity of IL-2, a lower level or activity of eotaxin, and a greater level or activity of sgp130; compared to a reference, e.g., a subject at low risk of severe CRS or compared to a control level or activity.

In some embodiments of the methods, compositions for use, kits and systems, a subject at high risk of severe CRS is identified as having a greater level or activity of IFN-gamma, an altered (e.g., greater) level or activity of IL-2, or a lower level or activity of eotaxin, or a combination thereof (e.g., in a sample, e.g., a blood sample) compared to a reference, e.g., a subject at low risk of severe CRS or compared to a control level or activity. In some embodiments, the subject is a pediatric subject. In some embodiments, a subject at high risk of severe CRS is identified as having: a greater level or activity of IFN-gamma and an altered (e.g., greater) level or activity of IL-2; a greater level or activity of IFN-gamma and a lower level or activity of eotaxin; an altered (e.g., greater) level or activity of IL-2 and a lower level or activity of eotaxin; or a greater level or activity of IFN-gamma, an altered (e.g., greater) level or activity of IL-2, and a lower level or activity of eotaxin; compared to a reference, e.g., a subject at low risk of severe CRS or compared to a control level or activity.

In some embodiments of the methods, compositions for use, kits and systems, a subject at high risk of severe CRS is identified as having a greater level or activity of IL-10 or a greater level of disease burden, or a combination thereof (e.g., in a sample, e.g., a blood sample) compared to a reference, e.g., a subject at low risk of severe CRS or compared to a control level or activity. In some embodiments, the subject is a pediatric subject.

In some embodiments of the methods, compositions for use, kits and systems, a subject at high risk of severe CRS is identified as having a greater level or activity of IFN-gamma or a lower level of IL-13, or a combination thereof (e.g., in a sample, e.g., a blood sample) compared to a reference, e.g., a subject at low risk of severe CRS or compared to a control level or activity. In some embodiments, the subject is a pediatric subject.

In some embodiments of the methods, compositions for use, kits and systems, a subject at high risk of severe CRS is identified as having a greater level or activity of IFN-gamma, a lower level or activity of IL-13, a lower level or activity of MIP1-alpha, or a combination thereof (e.g., in a sample, e.g., a blood sample) compared to a reference, e.g., a subject at low risk of severe CRS or compared to a control level or activity. In some embodiments, the subject is a pediatric subject. In some embodiments, a subject at high risk of severe CRS is identified as having: a greater level or activity of IFN-gamma or a lower level or activity of IL-13; a greater level or activity of IFN-gamma or a lower level or activity of MIP1-alpha; a lower level or activity of IL-13 or a lower level or activity of MIP1-alpha; or a greater level or activity of IFN-gamma, a lower level or activity of IL-13, and a lower level or activity of MIP1-alpha; compared to a reference, e.g., a subject at low risk of severe CRS or compared to a control level or activity. In some embodiments, a subject at high risk of severe CRS is identified as having: a greater level or activity of IFN-gamma and a lower level or activity of IL-13; a greater level or activity of IFN-gamma and a lower level or activity of MIP1-alpha; a lower level or activity of IL-13 and a lower level or activity of MIP1-alpha; or a greater level or activity of IFN-gamma, a lower level or activity of IL-13, and a lower level or activity of MIP1-alpha; compared to a reference, e.g., a subject at low risk of severe CRS or compared to a control level or activity.

In some embodiments of the methods, compositions for use, kits, and systems, a subject at high risk of severe CRS is identified as having a greater level or activity of IFN-gamma or a lower level or activity of MIP1-alpha, or a combination thereof (e.g., in a sample, e.g., a blood sample) compared to a reference, e.g., a subject at low risk of severe CRS or compared to a control level or activity. In some embodiments, the subject is a pediatric subject.

In some embodiments, e.g., in a 3-biomarker panel, e.g., containing IL2, eotaxin, and sgp130, or in a 3-biomarker panel containing IFN-gamma, IL2, and eotaxin (e.g., in pediatric patients) a greater level or activity of IL2 indicates that a subject is at high risk of severe CRS. In other embodiments, e.g., in a 2-biomarker panel, e.g., for pediatric patients, a greater level or activity of IL2 indicates that a subject is at low risk of severe CRS.

In some embodiments of the methods, compositions for use, kits and systems, a greater level of a marker described herein is a level greater than or equal to 1, 2, 5, 10, 20, 50, 100, 200, 500, 1000, 2000, 5000, 10,000, 20,000, 50,000, 100,000, 200,000, or 500,000 pg/ml. In some embodiments, a greater level of sgp130 is greater than or equal to 150,000, 200,000, 210,000, 215,000, 218,000, 218,179, 220,000, 225, 000, 230,000, or 250,000 pg/ml. In some embodiments, a greater level of IFN-gamma is greater than or equal to 6, 7, 8, 9, 10, 10.4272, 10.5, 11, 12, 13, 14, 15, 16, 17, 18, 19, 20, 21, 22, 23, 24, 25, 26, 27, 27.6732, 28, 29, 30, 31, 32, 33, 34, 35, 40, 50, 60, 70, 75, 80, 85, 90, 91, 92, 93, 94, 94.8873, 95, 96, 97, 98, 99, 100, 105, 110, 115, or 120 pg/ml. In some embodiments, a greater level of IL-10 is greater than or equal to 5, 6, 7, 8, 9, 10, 11, 11.7457, 12, 13, 14, 15, 16, 17, 18, 19, or 20 pg/ml. In some embodiments, a greater tumor burden is greater than or equal to 25, 30, 35, 40, 45, 50, 51.9, 55, 60, 65, 70, or 75% In some embodiments, a lower level of sgp130, IFN-gamma, IL-10, or tumor burden is a level less than or equal to any of the values in this paragraph.

In some embodiments of the methods, compositions for use, kits and systems, a lower level of a marker described herein is a level greater than or equal to 1, 2, 5, 10, 20, 50, 100, 200, 500, 1000, 2000, 5000, 10,000, 20,000, 50,000, 100,000, 200,000, or 500,000 pg/ml. In some embodiments, a lower level of IL1Ra is less than or equal to 550, 575, 600, 625, 650, 657.987, 675, 700, 720, or 750 pg/ml. In some embodiments, a lower level of MCP1 is less than or equal to 3500, 4000, 4100, 4200, 4300, 4400, 4500, 4600, 4636.52, 4700, 4800, 4900, 5000, or 5500 pg/ml. In some embodiments, a lower level of eotaxin is less than or equal to 20, 21, 22, 23, 24, 25, 26, 27, 28, 29, 29.0902, 30, 31, 32, 33, 34, 35, 36, 37, 38, 39, or 40 pg/ml. In some embodiments, a lower level of MIP1a is less than or equal to 20, 21, 22, 23, 24, 25, 26, 27, 28, 29, 30, 30.1591, 31, 32, 33, 34, 35, 36, 37, 38, 39, or 40 pg/ml. In some embodiments, a greater level of IL1Ra, MCP1, eotaxin, or MIP1a is a level greater than or equal to any of the values in this paragraph.

In some embodiments of the methods, compositions for use, kits and systems, the sensitivity is at least 0.75, 0.79, 0.80, 0.82, 0.85, 0.86, 0.90, 0.91, 0.93, 0.95, 0.96, 0.97, 0.98, 0.99, or 1.0. In some embodiments, the specificity is at least 0.75, 0.77, 0.80, 0.85, 0.86, 0.89, 0.90, 0.92, 0.94, 0.95, 0.96, 0.97, 0.98, 0.99, or 1.0. In some embodiments, the PPV is at least 0.62, 0.65, 0.70, 0.71, 0.75, 0.80, 0.82, 0.83, 0.85, 0.90, 0.91, 0.92, 0.95, 0.96, 0.97, 0.98, 0.99, or 1.0. In some embodiments, the NPV is at least 0.80, 0.85, 0.90, 0.92, 0.94, 0.95, 0.96, 0.97, 0.98, 0.99, or 1.0.

In some embodiments of the methods, compositions for use, kits and systems, a measure of eotaxin comprises a measure of one or more (e.g., two or all of) eotaxin-1, eotaxin-2, and eotaxin-3. In some embodiments, a measure of eotaxin comprises a measure of eotaxin-1 and eotaxin-2, eotaxin-1 and eotaxin-3, or eotaxin-2 and eotaxin-3.

In some embodiments of the methods, compositions for use, kits and systems, the biomarkers are measured within 3 days of infusion of the CAR-expressing cell therapy, e.g., 1, 2, or 3 days after infusion. In some embodiments, the biomarkers comprise IFN-gamma and/or sgp130.

Any of the methods disclosed herein can further include the step of acquiring a measure of the level or activity of one, two, three, four, five, ten, twenty or more of a cytokine or cytokine receptor chosen from sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, or GM-CSF, or a combination thereof, in the subject, e.g., in a sample (e.g., a blood sample) from the subject. In some embodiments, a subject having, or at high risk of having, severe CRS has, or is identified as having, a greater level or activity of one or more (e.g., two, three, four, five, ten, fifteen, twenty, or all) of a cytokine or cytokine receptor chosen from sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, or GM-CSF or a combination thereof, compared to a reference, e.g., a subject at low risk of severe CRS or compared to a control level or activity.

Any of the methods disclosed herein can further include the step of acquiring a measure of the level or activity of one, two, three, four, five, six, seven, eight, or all of a cytokine or cytokine receptor chosen from IFN-γ, IL10, IL6, IL8, IP10, MCP1, M1G, sIL2Rα, GM-CSF, or TNFα, or a combination thereof, in the subject, e.g., in a sample (e.g., a blood sample) from the subject. In some embodiments, a subject having, or at high risk of having, severe CRS has, or is identified as having, a greater level or activity of one or more (e.g., two, three, four, five, six, seven, eight, or all) of a cytokine or cytokine receptor chosen from IFN-γ, IL10, IL6, IL8, IP10, MCP1, M1G, sIL2Rα, GM-CSF, or TNFα or a combination thereof, compared to a reference, e.g., a subject at low risk of severe CRS or compared to a control level or activity.

Any of the methods disclosed herein can further include the step of acquiring a measure of the level or activity of one, two, three, four, five, six, or all of a cytokine or cytokine receptor chosen from IFN-γ, IL10, IL6, IL8, IP10, MCP1, M1G, or sIL2Rα, or a combination thereof, in the subject, e.g., in a sample (e.g., a blood sample) from the subject. In some embodiments, a subject having, or at high risk of having, severe CRS has, or is identified as having, a greater level or activity of one or more (e.g., two, three, four, five, six, or all) of a cytokine or cytokine receptor chosen from IFN-γ, IL10, IL6, IL8, IP10, MCP1, M1G, or sIL2Rα, or a combination thereof, compared to a reference, e.g., a subject at low risk of severe CRS or compared to a control level or activity.

In some embodiments, any the methods disclosed herein can further include the step of determining the level of C-reactive protein (CRP) in a sample (e.g., a blood sample) from the subject. In one embodiment, a subject at low risk of severe CRS has, or is identified as having, a CRP level of less than 7 mg/dL (e.g., 7, 6.8, 6, 5, 4, 3, 2, 1 mg/dL or less). In one embodiment, a subject at high risk of severe CRS has, or is identified as having, a greater level of CRP in a sample (e.g., a blood sample) compared to a subject at low risk of severe CRS or compared to a control level or activity. In one embodiment, the greater level or activity is at least 2-fold greater (e.g., at least 2, 3, 4, 5, 6, 7, 8, 9, 10, 15, 20, 25, 30, 40, 50, 100, 500, 1000-fold or greater) compared to a subject at low risk of severe CRS or compared to a control level or activity.

In other embodiments, the methods, compositions for use, kits and systems disclosed herein further include the step of selecting or altering the therapy, e.g., the CAR-expressing cell therapy, for the subject, based on the CRS risk status acquired. In embodiments where the CRS risk status acquired is that the subject is at high risk of severe CRS, the therapy is altered such that it is discontinued, or a subsequent (e.g., second, third, or fourth) dose of the therapy (e.g., the CAR-expressing cells) is at a lower dose than the previous dose or is at a lower dose than would have been administered had the patient not been at high risk of severe CRS. In other embodiments, a subsequent (e.g., second, third, or fourth) dose of CAR-expressing cells comprises a different CAR or different cell type than the previous CAR-expressing cell therapy administered to the subject.

In embodiments of the methods, compositions for use, kits or systems disclosed herein, the therapy is a CAR-expressing cell therapy, alone or in combination with other therapies. In embodiments, the therapy comprises a plurality of CAR-expressing immune effector cells (e.g., T cells or NK cells). In some embodiment, the CAR-expressing cell therapy comprises, or consists of, a CAR19 therapy (e.g., CTL019 therapy as described herein).

In other embodiments, the therapy is a CD19-inhibiting or depleting therapy, e.g., a therapy that includes a CD19 inhibitor. In embodiments, the CD19-inhibiting or depleting therapy is associated with CRS. In some embodiments, the CD19 inhibitor is a CD19 antibody, e.g., a CD19 bispecific antibody (e.g., a bispecific T cell engager that targets CD19, e.g., blinatumomab). In some embodiments, the bispecific T cell engager antibody molecule is an antibody molecule described in Bargou et al., "Tumor regression in cancer patients by very low doses of a T cell-engaging antibody." Science. 2008 Aug. 15; 321(5891):974-7. doi: 10.1126/science.1158545.

In some embodiments, the therapy includes a CD19 CAR-expressing cell, e.g., a CD19 CART cell, or an anti-CD19 antibody (e.g., an anti-CD19 mono- or bispecific antibody) or a fragment or conjugate thereof. In one embodiment, the anti-CD19 antibody is a humanized antigen binding domain as described in WO2014/153270 (e.g., Table 3 of WO2014/153270) incorporated herein by reference, or a conjugate thereof. Other exemplary anti-CD19 antibodies or fragments or conjugates thereof, include but are not limited to, blinatumomab, SAR3419 (Sanofi), MEDI-551 (MedImmune LLC), Combotox, DT2219ARL (Masonic Cancer Center), MOR-208 (also called XmAb-5574; MorphoSys), XmAb-5871 (Xencor), MDX-1342 (Bristol-Myers Squibb), SGN-CD19A (Seattle Genetics), and AFM11 (Affimed Therapeutics). See, e.g., Hammer. MAbs. 4.5(2012): 571-77. Blinatomomab is a bispecific antibody comprised of two scFvs—one that binds to CD19 and one that binds to CD3. Blinatomomab directs T cells to attack cancer cells. See, e.g., Hammer et al.; Clinical Trial Identifier No. NCT00274742 and NCT01209286. MEDI-551 is a humanized anti-CD19 antibody with a Fc engineered to have enhanced antibody-dependent cell-mediated cytotoxicity (ADCC). See, e.g., Hammer et al.; and Clinical Trial Identifier No. NCT01957579. Combotox is a mixture of immunotoxins that bind to CD19 and CD22. The immunotoxins are made up of scFv antibody fragments fused to a deglycosylated ricin A chain. See, e.g., Hammer et al.; and Herrera et al. J. Pediatr. Hematol. Oncol. 31.12(2009):936-41; Schindler et al. Br. J. Haematol. 154.4(2011):471-6. DT2219ARL is a bispecific immunotoxin targeting CD19 and CD22, comprising two scFvs and a truncated diphtheria toxin. See, e.g., Hammer et al.; and Clinical Trial Identifier No. NCT00889408. SGN-CD19A is an antibody-drug conjugate (ADC) comprised of an anti-CD19 humanized monoclonal antibody linked to a synthetic cytotoxic cell-killing agent, monomethyl auristatin F (MMAF). See, e.g., Hammer et al.; and Clinical Trial Identifier Nos. NCT01786096 and NCT01786135. SAR3419 is an anti-CD19 antibody-drug conjugate (ADC) comprising an anti-CD19 humanized monoclonal antibody conjugated to a maytansine derivative via a cleavable linker. See, e.g., Younes et al. J. Clin. Oncol. 30.2(2012): 2776-82; Hammer et al.; Clinical Trial Identifier No. NCT00549185; and Blanc et al. Clin Cancer Res. 2011; 17:6448-58. XmAb-5871 is an Fc-engineered, humanized anti-CD19 antibody. See, e.g., Hammer et al. MDX-1342 is a human Fc-engineered anti-CD19 antibody with enhanced ADCC. See, e.g., Hammer et al. In embodiments, the antibody molecule is a bispecific anti-CD19 and anti-CD3 molecule. For instance, AFM11 is a bispecific antibody that targets CD19 and CD3. See, e.g., Hammer et al.; and Clinical Trial Identifier No. NCT02106091. In some embodiments, an anti-CD19 antibody described herein is conjugated or otherwise bound to a therapeutic agent, e.g., a chemotherapeutic agent, peptide vaccine (such as that described in Izumoto et al. 2008 J Neurosurg 108:963-971), immunosuppressive agent, or immunoablative agent, e.g., cyclosporin, azathioprine, methotrexate, mycophenolate, FK506, CAMPATH, anti-CD3 antibody, cytoxin, fludarabine, rapamycin, mycophenolic acid, steroid, FR901228, or cytokine.

In embodiments of the methods, compositions for use, kits or systems disclosed herein, the cancer, e.g., the hematological cancer, is associated with CD19 expression. Exemplary cancers, e.g., hematological cancers, include, but are not limited to, B-cell acute lymphocytic leukemia (B-ALL), T-cell acute lymphocytic leukemia (T-ALL), acute lymphocytic leukemia (ALL), chronic myelogenous leukemia (CML), chronic lymphocytic leukemia (CLL), B cell promyelocytic leukemia, blastic plasmacytoid dendritic cell neoplasm, Burkitt's lymphoma, diffuse large B cell lymphoma, GC (germinal center)-DLBCL, NGC (non-germinal center)-DLBCL, transformed FL, double hit DLBCL, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, and Waldenstrom macroglobulinemia. In one embodiment, the cancer is chosen from one or more of CLL, ALL, or B-ALL. In an embodiment, the subject has CLL. In another embodiment, the subject has ALL. In another embodiment, the subject has B-cell ALL.

In other embodiments of the methods, compositions for use, kits or systems disclosed herein, the measure of one or more of biomarkers (e.g., one or more biomarkers of (i)-(xi)) is obtained from a sample (e.g., a blood sample) acquired from the subject. In some embodiments, the subject, e.g., a sample from the subject, is evaluated while receiving the CAR-expressing cell therapy. In other embodiments, the subject, e.g., a sample from the subject, is evaluating after receiving the CAR-expressing cell therapy. For example, the subject, e.g., a sample from the subject, is evaluated 10 days or less (e.g., 1-10 days, 1-9 days, 1-8 days, 1-7 days, 1-6 days, 1-5 days, 1-4 days, 1-3 days, or 1-2 days, 5 days or less, 4 days or less, 3 days or less, 2 days or less, 1 day or less, e.g., 1, 3, 5, 10, 12, 15, 20 hours) after infusion with the CAR-expressing cell therapy. In some embodiments, the subject is evaluated 5 days or less, 4 days or less, 3 days or less, 2 days or less, 1 day or less (e.g., but no earlier than 1, 3, 5, 10, 12, 15, 20 hours, after infusion of the CAR-expressing therapy). In other embodiments, the measure of one or more of biomarkers comprises detection of one or more of nucleic acid (e.g., mRNA) levels or protein levels.

In any of the methods or compositions for use described herein, in some embodiments, a dose of CAR-expressing cells (e.g., CD19 CAR-expressing cells or BCMA CAR-expressing cells) comprises about $10^4$ to about $10^9$ cells/kg, e.g., about $10^4$ to about $10^5$ cells/kg, about $10^5$ to about $10^6$ cells/kg, about $10^6$ to about $10^7$ cells/kg, about $10^7$ to about $10^8$ cells/kg, or about $10^8$ to about $10^9$ cells/kg; or at least about one of: $1\times10^7$, $1.5\times10^7$, $2\times10^7$, $2.5\times10^7$, $3\times10^7$, $3.5\times10^7$, $4\times10^7$, $5\times10^7$, $1\times10^8$, $1.5\times10^8$, $2\times10^8$, $2.5\times10^8$, $3\times10^8$, $3.5\times10^8$, $4\times10^8$, $5\times10^8$, $1\times10^9$, $2\times10^9$, or $5\times10^9$ cells. In some embodiments, a dose of CAR-expressing cells (e.g., CD19 CAR-expressing cells) comprises at least about $1\text{-}5\times10^7$ to $1\text{-}5\times10^8$ CAR-expressing cells In some embodiments, the subject is administered about $1\text{-}5\times10^7$ CAR-expressing cells (e.g., CD19 CAR-expressing cells). In other embodiments, the subject is administered about $1-5\times10^8$ CAR-expressing cells (e.g., CD19 CAR-expressing cells).

In embodiments, the CAR-expressing cells (e.g., CD19 CAR-expressing cells or BCMA CAR-expressing cells) are administered to the subject according to a dosing regimen comprising a total dose of cells administered to the subject by dose fractionation, e.g., one, two, three or more separate administration of a partial dose. In embodiments, a first percentage of the total dose is administered on a first day of treatment, a second percentage of the total dose is administered on a subsequent (e.g., second, third, fourth, fifth, sixth, or seventh or later) day of treatment, and optionally, a third percentage (e.g., the remaining percentage) of the total dose is administered on a yet subsequent (e.g., third, fourth, fifth, sixth, seventh, eighth, ninth, tenth, or later) day of treatment. For example, 10% of the total dose of cells is delivered on the first day, 30% of the total dose of cells is delivered on the second day, and the remaining 60% of the total dose of cells is delivered on the third day of treatment. For example, a total cell dose includes 1 to $5\times10^7$ or 1 to $5\times10^8$ CAR-expressing cells (e.g., CD19 CAR-expressing cells or BCMA CAR-expressing cells).

In another aspect, the invention features a method of determining whether a subject has severe CRS. The method includes acquiring a CRS risk status, e.g., in response to an immune cell based therapy, e.g., a CAR-expressing cell therapy (e.g., a CAR19-expressing cell therapy) for the subject, wherein said CRS risk status includes a measure of one, two, or more (all) of the following:

(i) the level or activity of one or more (e.g., 3, 4, 5, 10, 15, 20, or more) cytokines or cytokine receptors chosen from sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1B, or GM-CSF, or analytes chosen from C-reactive protein (CRP), ferritin, lactate dehydrogenase (LDH), aspartate aminotransferase (AST), or blood urea nitrogen (BUN), alanine aminotransferase (ALT), creatinine (Cr), or fibrinogen, or a combination thereof, in a sample (e.g., a blood sample);

(ii) the level or activity of IL6, IL6R, or sgp130, or a combination thereof (e.g., a combination of any two or all three of IL6, IL6R, and sgp130), in a sample (e.g., a blood sample); or (iii) the level or activity of IL6, IFN-gamma, or IL2R, or a combination thereof (e.g., a combination of any two or all three of IL6, IFN-gamma, and IL2R), in a sample (e.g., a blood sample);

wherein the value is indicative of the subject's severe CRS status.

In embodiments, an elevated level of the cytokines or cytokine receptors (i)-(iii), or all analytes except fibrinogen, is indicative of severe CRS. In embodiments, low fibrinogen is indicative of severe CRS.

In another aspect, the invention features a kit for evaluating, e.g., predicting, a subject's risk of developing cytokine release syndrome (CRS), e.g., severe CRS. The kit includes a set of reagents that specifically detects the level or activity of one or more genes or proteins chosen from: sgp130 and IFN-gamma; sgp130, IFN-gamma, and IL1Ra; or sgp130, IFN-gamma, and MIN-alpha; sgp130, MCP1, and eotaxin; IL2, eotaxin, and sgp130; IFN-gamma, IL2, and eotaxin; IFN-gamma and IL-13; or IFN-gamma, IL-13, and MIP1-alpha; or a combination thereof; and instructions for using said kit. In embodiments, the instructions for use provide that if one or more of the detected level or activity of IFN-gamma, sgp130, or MCP1 is greater than a reference value, and/or if one or more of the detected level or activity of IL-13, IL1Ra, MIP1alpha, or eoxtaxin is less than a reference value, or any combination thereof, the subject is more likely to develop CRS (e.g., severe CRS) than a subject having a detected level or activity at the reference value.

In some embodiments, the one or more genes further comprise one or more of sTNFR2, IP10, sIL1R2, sTNFR1, M1G, VEGF, sILR1, TNFα, IFNα, GCSF, sRAGE, IL4, IL10, IL1R1, IL6, IL8, sIL2Rα, sIL6R, MCP1, MIP1β, or GM-CSF. The kit may include a reaction mixture that includes one or more of: extraction buffer/reagents, amplification buffer/reagents, hybridization buffer/reagents, or labeling buffer/reagents.

In some embodiments of the aforesaid kits, the set of reagent detects the level of a gene product (e.g., mRNA expressed) from said set of genes. For example, the set of reagents includes a nucleic acid probe (e.g., cDNA or oligonucleotides) complementary to an mRNA expressed from said set of genes. The nucleic acid probe complementary to the mRNA can be immobilized on a substrate surface.

In other embodiments of the aforesaid kits, the set of reagent detects the expression of polypeptides encoded by said set of genes. In some embodiments, the reagents comprise antibody molecules, e.g., non-human antibody molecules. The non-human antibody molecules can recognize human proteins, e.g., one or more of sgp130 and IFN-gamma; sgp130, IFN-gamma, and IL1Ra; or sgp130, IFN-gamma, and MIP1-alpha; sgp130, MCP1, and eotaxin; IL2, eotaxin, and sgp130; IFN-gamma, IL2, and eotaxin; IFN-gamma and IL-13; or IFN-gamma, IL-13, and MIP1-alpha; or any combination thereof.

In certain embodiments, e.g., systems and methods involving a decision tree, e.g., a decision tree with the biomarkers, the method ends when the CRS risk status is first identified, e.g., as high or low CRS risk status. In embodiments, the method comprises performing the following steps in the following order: (i) and (ii); (i), (ii), and (iii); (i), (ii), (iii), and (iv); (i), (ii), (iii), (iv), and (v); (i), (ii), (iii), (iv), (v), and (vi); (i), (ii), (iii), (iv), (v), and (vii); or (i), (ii), (iii), (iv), (v), (vi), and (vii). In embodiments, steps (i), (iii), and (v) are performed. In an embodiment, steps (i), (iii), and (v) are performed simultaneously. In an embodiment, steps (i), (iii), and (v) are performed substantially simultaneously. In an embodiment, steps (i), (iii), and (v) are performed on the same day, or within 1, 2, 3, 4, 6, 12, or 24 hours of each other. In embodiments, the method comprises, after performing steps (i), (iii), and (v), performing the following steps in the following order: (ii); (ii) and (iv); (ii), (iv), and (vi); (ii), (iv), and (vii); or (ii), (iv), (vi), and (vii).

In certain embodiments, e.g., systems and methods involving a decision tree, e.g., a decision tree with two biomarkers, the method ends when the CRS risk status is first identified, e.g., as high or low CRS risk status. In embodiments, the method comprises performing the following steps in the following order: (i) and (ii); (i), (ii), and (iii); (i), (ii), (iii), and (iv); (i), (ii), (iii), and (v); or (i), (ii), (iii), (iv), and (v). In embodiments, steps (i) and (iii) are performed. In embodiments, steps (i) and (iii) are performed simultaneously. In an embodiment, steps (i) and (iii) are performed substantially simultaneously. In an embodiment, steps (i) and (iii) are performed on the same day, or within 1, 2, 3, 4, 6, 12, or 24 hours of each other. In embodiments, the method comprises, after performing steps (i) and (iii), performing the following steps in the following order: (ii); (ii) and (iv); (ii) and (v); or (ii), (iv), and (vi).

In some embodiments, the systems and methods herein comprise performing regression analysis. In some embodiments, the systems and methods herein comprise performing decision tree analysis. In some embodiments, the systems and methods herein comprise acquiring cytokine or cytokine receptor levels (and not activities).

In another aspect, the invention features a system for evaluating, e.g., predicting, a subject's risk of developing cytokine release syndrome (CRS), e.g., severe CRS. The system includes at least one processor operatively connected to a memory, wherein the at least one processor when executing is configured to acquire a CRS risk status, e.g., in response to an immune cell based therapy (e.g., a CAR-expressing cell therapy (e.g., a CAR19-expressing cell therapy)) for the subject, wherein said CRS risk status comprises a measure of one, two, three, four, five, six, seven, eight, nine, or more (all) of the following:

(i) the level or activity of soluble gp130 (sgp130) or interferon-gamma (IFN-gamma), or a combination thereof, in the subject, e.g., in a sample (e.g., a blood sample), e.g., wherein the subject is an adult or pediatric subject;

(ii) the level or activity of sgp130, IFN-gamma, or IL1Ra, or a combination thereof (e.g., a combination of any two or all three of sgp130, IFN-gamma, and IL1Ra), in the subject, e.g., in a sample (e.g., a blood sample), e.g., wherein the subject is an adult or pediatric subject;

(iii) the level or activity of sgp130 or IFN-gamma or a combination thereof, in a sample (e.g., a blood sample), and the level of bone marrow disease in the subject, e.g., wherein the subject is a pediatric subject;

(iv) the level or activity of sgp130, IFN-gamma, or MIP1-alpha, or a combination thereof (e.g., a combination of any two or all three of sgp130, IFN-gamma, and MIP1-alpha), in a sample (e.g., a blood sample), e.g., wherein the subject is a pediatric subject;

(v) the level or activity of sgp130, MCP1, or eotaxin, or a combination thereof (e.g., a combination of any two or all three of sgp130, MCP1, or eotaxin), in the subject, e.g., in a sample (e.g., a blood sample), e.g., wherein the subject is an adult or a pediatric subject;

(vi) the level or activity of IL-2, eotaxin, or sgp130, or a combination thereof (e.g., a combination of any two or all three of I-L2, eotaxin, or sgp130), in the subject, e.g., in a sample (e.g., a blood sample), e.g., wherein the subject is an adult or a pediatric subject;

(vii) the level or activity of IFN-gamma, IL2, or eotaxin, or a combination thereof (e.g., a combination of any two or all three of IFN-gamma, IL2, or eotaxin), in the subject, e.g., in a sample (e.g., a blood sample), e.g., wherein the subject is a pediatric subject;

(viii) the level or activity of IL10 and the level of disease burden in the subject, or a combination thereof in a subject, e.g., in a sample (e.g., a blood sample), e.g., wherein the subject is a pediatric subject;

(ix) the level or activity of IFN-gamma or IL-13, or a combination thereof, in the subject, e.g., wherein the subject is a pediatric subject;

(x) the level or activity of IFN-gamma, IL-13, or MIP1-alpha, or a combination thereof (e.g., a combination of any two or all three of IFN-gamma, IL-13, and MIP1-alpha), in a sample (e.g., a blood sample), e.g., wherein the subject is a pediatric subject; or (xi) the level or activity of IFN-gamma or MIP1-alpha, or a combination thereof, in a sample (e.g., a blood sample), e.g., wherein the subject is a pediatric subject.

In some embodiments, responsive to a determination of the CRS risk status, perform one, two, three, four or more of:
identify the subject as at high risk of developing severe CRS or at low risk of developing severe CRS;

recommend a selection or alteration of a dosing of a CAR-expressing cell therapy;

recommend a selection or alteration of a schedule or time course of a CAR-expressing cell therapy;

recommend administering a therapy to treat CRS, e.g., an IL-6 inhibitor, such as tocilizumab, a vasoactive medication, an immunosuppressive agent, a corticosteroid, or mechanical ventilation;

recommend a selection of an alternative therapy, e.g., for a severe CRS subject, e.g., a standard of care for a particular cancer type.

In some embodiments, the system is used to evaluate cancer, e.g., a hematological cancer as described herein, in the subject. In some embodiments, the cancer is associated with CD19 expression. For example, the cancer can be chosen from CLL, ALL or B-ALL.

In embodiments of the systems described herein, the CAR-expressing cell therapy comprises a plurality of CAR-expressing immune effector cells, e.g., as described herein. For example, the CAR-expressing cell therapy comprises, or consists of, a CAR19 therapy (e.g., CTL019 therapy).

In some aspects, the present disclosure provides a system for evaluating cancer, e.g., a hematological cancer, in a subject, comprising at least one processor operatively connected to a memory, the at least one processor when executing is configured to perform any one or more of the steps recited herein, e.g., recited above.

In some aspects, the disclosure provides a method of treating GC (germinal center)-DLBCL, NGC (non-germinal center)-DLBCL, transformed FL, or double hit DLBCL, comprising administering to a patient in need thereof a CD19 CAR-expressing cell, thereby treating the GC-DLBCL, NGC-DLBCL, transformed FL, or double hit DLBCL.

In some embodiments, the CD19 CAR (or a nucleic acid encoding it) comprises a sequence set out in any of Table 3, Table 4, Table 5, Table 6, or Table 7. In embodiments, the CD19 CAR is CTL019. In embodiments, the double hit DLBCL is DLBCL having chromosomal breakpoints affecting the MYC/8q24 locus and a second oncogene locus and arising either from transformation of follicular lymphoma or de novo. In embodiments, the DLBCL is a CD19+ DLBCL. In embodiments, the DLBCL is stage I, II, III, or IV. In embodiments, the DLBCL has bone marrow involvement. In embodiments, the DLBCL is GC-DLBCL or NGC-DLBCL. In embodiments, the second oncogene locus is BCL2 or BCL6. In embodiments, the patient received lymphodepleting chemotherapy prior to administration of the CD19 CAR-expressing cell. In embodiments, a single dose of CD19 CAR-expressing cells are administered. In embodiments, the patient experiences CRS. In embodiments, the patient experiences a response, e.g., complete response. In embodiments, the CD19 CAR-expressing cells (e.g., CTL019 cells) are administered at a dose of about $5 \times 10^8$ cells, e.g., about $4-6 \times 10^8$ cells. In embodiments, the CD19 CAR-expressing cells (e.g., CTL019 cells) are administered at a dose of about $5-7 \times 10^6$ cells/kg. In embodiments, the CD19 CAR-expressing cells (e.g., CTL019 cells) are administered at a dose of about $2 \times 10^8$ cells, e.g., about $1-3 \times 10^8$ cells. In embodiments, the CD19 CAR-expressing cells (e.g., CTL019 cells) are administered at a dose of about $3 \times 10^6$ cells/kg, e.g., about $2-4 \times 10^6$ cells/kg.

In some aspects, the present disclosure provides a method of distinguishing between CRS and sepsis in a subject, comprising acquiring a measure of one or more of the following:

(i) the level or activity of one or more of (e.g., 2, 3, 4, 5, 6, 7, 8, 9, 10, 11, 12, 13, 14, 15, or all of) GM-CSF, HGF, IFN-γ, IFN-α, IL-10, IL-15, IL-5, IL-6, IL-8, IP-10, MCP1, MIG, MIP-1β, sIL-2Rα, sTNFRI, and sTNFRII, wherein a level or activity that is higher than a reference is indicative of CRS; or (ii) the level or activity of one or more of (e.g., 2, 3, 4, 5, 6, or all of) CD163, IL-1β, sCD30, sIL-4R, sRAGE, sVEGFR-1, and sVEGFR-2, wherein a level or activity that is higher than a reference is indicative of sepsis.

In embodiments, the method comprises administering a therapy to treat CRS if the measure is indicative of CRS. In embodiments, the method comprises administering a therapy to treat sepsis if the measure is indicative of sepsis.

The present disclosures also provides, in some aspects, a kit for distinguishing between CRS and sepsis in a patient, the kit comprising a set of reagents that specifically detects the level or activity of one or more (e.g., 2, 3, 4, 5, 6, 7, 8, 9, 10, 11, 12, 13, 14, 15, 16, 17, 18, 19, 20, 2, 22, or all of) genes or proteins chosen from:

GM-CSF, HGF, IFN-γ, IFN-α, IL-10, IL-15, IL-5, IL-6, IL-8, IP-10, MCP1, MIG, MIP-1β, sIL-2Rα, sTNFRI, sTN-FRII, CD163, IL-1β, sCD30, sIL-4R, sRAGE, sVEGFR-1, and sVEGFR-2; and instructions for using said kit;

wherein said instructions for use provide that if one or more of (e.g., 2, 3, 4, 5, 6, 7, 8, 9, 10, 11, 12, 13, 14, 15, or all of) the detected level or activity of GM-CSF, HGF, IFN-γ, IFN-α, IL-10, IL-15, IL-5, IL-6, IL-8, IP-10, MCP1, MIG, MIP-1β, sIL-2Rα, sTNFRI, or sTNFRII is greater than a reference value, the subject is likely to have CRS, and/or if one or more of (e.g., 2, 3, 4, 5, 6, or all of) the detected level or activity of CD163, IL-1β, sCD30, sIL-4R, sRAGE, sVEGFR-1, or sVEGFR-2, is greater than a reference value, the subject is likely to have sepsis.

The present disclosure also provides, in some aspects, a reaction mixture comprising:

a set of reagents that specifically detects the level or activity of one or more (e.g., 2, 3, 4, 5, 6, 7, 8, 9, 10, 11, 12, 13, 14, 15, 16, 17, 18, 19, 20, 2, 22, 23, or all of) genes or proteins chosen from: GM-CSF, HGF, IFN-γ, IFN-α, IL-10, IL-15, IL-5, IL-6, IL-8, IP-10, MCP1, MIG, MIP-1β, sIL-2Rα, sTNFRI, sTNFRII, CD163, IL-1β, sCD30, sIL-4R, sRAGE, sVEGFR-1, and sVEGFR-2, and a biological sample, e.g., a blood sample.

In embodiments, the biological sample is from a subject treated with a CAR-expressing cell therapy and/or having a symptom of CRS and/or sepsis.

The present disclosure also provides, in certain aspects, a method of identifying sepsis in a subject, comprising acquiring a measure of one or more of the following:

(i) the level or activity of one or more of (e.g., 2, 3, 4, 5, 6, 7, 8, 9, 10, 11, 12, 13, 14, 15, 16, 17, 18, 19, 20, 21, 22, or all of) ANG2, GCSF, IFNα, IL1RA, IL4, IL6, MIG, MIP1α, PTX3, TNFα, sCD163, sCD30, sIL-1RI, sIL-1RII, sIL-2Rα, sIL-4R, sRAGE, sTNFRI, sTNFRII, sVEGFR1, sVEGFR2, sVEGFR3, and VEGF, wherein a level or activity that is greater relative to a reference is indicative of sepsis;

(ii) the level or activity of one or more of (e.g., both of) IL13 and RANTES, wherein a level or activity that is lower relative to a reference is indicative of sepsis.

In some aspects, the present disclosure provides a method of treating one or more of a neurological toxicity, CRS, or posterior reversible encephalopathy syndrome (PRES), comprising administering to a subject in need thereof a therapeutically effective amount of cyclophosphamide. In related aspects, the present disclosure provides cyclophosphamide for use in treating neurological toxicity, CRS, or posterior reversible encephalopathy syndrome (PRES). In embodiments, the administration of cyclophosphamide is subsequent to a cell-based therapy, e.g., a cell-based therapy for cancer, a CD19-inhibiting therapy, or a CD19-depleting therapy, or the subject has been previously treated with a cell-based therapy, e.g., a cell-based therapy for cancer, a CD19-inhibiting therapy, or a CD19-depleting therapy. In embodiments, the administration of cyclophosphamide is prior to, at the same time as, or after the cell-based therapy.

In embodiments, the patient has, or is identified as having, CRS, PRES, or both. In some embodiments, the subject has been treated with a CD19 inhibiting or depleting therapy. In some embodiments, the CD19 inhibitor is a CD19 antibody, e.g., a CD19 bispecific antibody (e.g., a bispecific T cell engager that targets CD19, e.g., blinatumomab). In some embodiments, the therapy comprises a CAR-expressing cell, e.g., an anti-BCMA CAR or anti-CD19 CAR. In embodiments, the subject suffers from a neurological toxicity, e.g., focal deficits (e.g., cranial nerve palsy or hemiparesis) or global abnormalities (e.g., generalized seizures, confusion), or status epilepticus. In embodiments, the subject does not have any clinical symptoms of CRS. In embodiments, the subject has one or more clinical symptoms of CRS. In embodiments, the subject has, or is identified as having, elevated IL-6 relative to a reference, e.g., to the subject's level of IL-6 prior to therapy with a CAR-expressing cell. In embodiments, the subject has, or is identified as having, elevated serum levels of a cytokine or cytokine receptor associated with CRS (e.g., IL-6 and/or IL-8) relative to a reference. In embodiments, the subject has, or is identified as having, elevated levels of a cytokine or cytokine receptor associated with CRS (e.g., CSF IL-6 and/or IL-8) relative to a reference. In embodiments, the subject is treated or has been treated with a therapy for CRS such as tocilizumab or a corticosteroid (e.g., (methylprednisolone, hydrocortisone, or both). In embodiments, the subject has, or is identified as having, an increase in circulating, activated CAR-expressing cells. In embodiments, the subject has, or is identified as having, CAR-expressing cells in the CSF. In embodiments, after the cyclophosphamide treatment, the subject has a reduced number of CAR-expressing cells in circulation compared to prior to cyclophosphamide treatment. In embodiments, the reduced number of CAR-expressing cells is a non-zero number, e.g., a detectable number.

In some aspects, the present disclosure provides a method of evaluating, e.g., predicting, a subject's responsiveness to an IL6 receptor inhibitor (e.g., tocilizumab), comprising evaluating the subject's IL-6R genotype, wherein a genotype associated with low sIL-6R levels is indicative of sensitivity to the IL6 receptor inhibitor (e.g., tocilizumab). In some aspects, the present disclosure also provides a method of evaluating, e.g., predicting, a subject's responsiveness to an IL6 receptor inhibitor (e.g., tocilizumab), comprising evaluating the subject's sIL-6R level, wherein a sIL-6R level that is lower than a reference level is indicative of sensitivity to the IL6 receptor inhibitor (e.g., tocilizumab).

In some embodiments, the subject has, is at risk of having, or is predicted to develop CRS (e.g., has an altered biomarker level as described herein).

In some embodiments, the subject has been treated with a CD19 inhibiting or depleting therapy. In some embodiments, method further comprises treating the subject with a CD19 inhibiting or depleting therapy. In some embodiments, the CD19 inhibitor is a CD19 antibody, e.g., a CD19 bispecific antibody (e.g., a bispecific T cell engager that targets CD19, e.g., blinatumomab). In some embodiments, the therapy comprises a CD19 CAR-expressing cell, e.g., a CD19 CAR-expressing cell described herein.

In some embodiments, the subject is tested for IL-6R genotype or sIL-6R level before or after administration of the CD19 inhibiting or depleting therapy. In some embodiments, the subject is tested for IL-6R genotype or sIL-6R level before or after developing CRS, or being before or after being identified as having CRS.

In some embodiments, evaluating the subject's IL-6R genotype comprises determining the subject's genotype at rs2228145. In embodiments, a subject having an A/A haplotype at rs2228145 is identified as being sensitive to a IL6 receptor inhibitor (e.g., tocilizumab).

In embodiments, the subject (e.g., a subject identified as being sensitive to an IL6 receptor inhibitor such as tocilizumab) is treated with an IL6 receptor inhibitor such as tocilizumab. In embodiments, the subject (e.g., a subject identified as having reduced sensitivity to an IL6 receptor inhibitor such as tocilizumab) is treated with a CRS therapy other than an IL6 receptor inhibitor, e.g., other than tocilizumab. In embodiments, the CRS therapy other than an IL6 receptor inhibitor comprises bazedoxifene, an sgp130 blocker, a vasoactive medication, a corticosteroid, an immunosuppressive agent, or mechanical ventilation. In embodiments, the subject (e.g., a subject identified as having reduced sensitivity to an IL6 receptor inhibitor such as tocilizumab) is treated with one or more additional doses, or a higher dose, of an IL6 receptor inhibitor (e.g., tocilizumab) compared to the ordinary course of treatment for a subject identified as being sensitive to the IL6 receptor inhibitor. In some embodiments, the subject identified as having reduced sensitivity to the IL6 receptor inhibitor is treated with at least 2, 3, or 4 doses of the IL6 receptor inhibitor, e.g., tocilizumab.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting. Headings, sub-headings or numbered or lettered elements, e.g., (a), (b), (i) etc, are presented merely for ease of reading. The use of headings or numbered or lettered elements in this document does not require the steps or elements be performed in alphabetical order or that the steps or elements are necessarily discrete from one another. Other features, objects, and advantages of the invention will be apparent from the description and drawings, and from the claims.

FIGS. 12A, 12B, 12C, and 12D depict peak levels of 19 cytokines during the first month after CTL019 infusion that were not differentially elevated in CRS4-5 compared to CRS0-3.

Figure 13A:
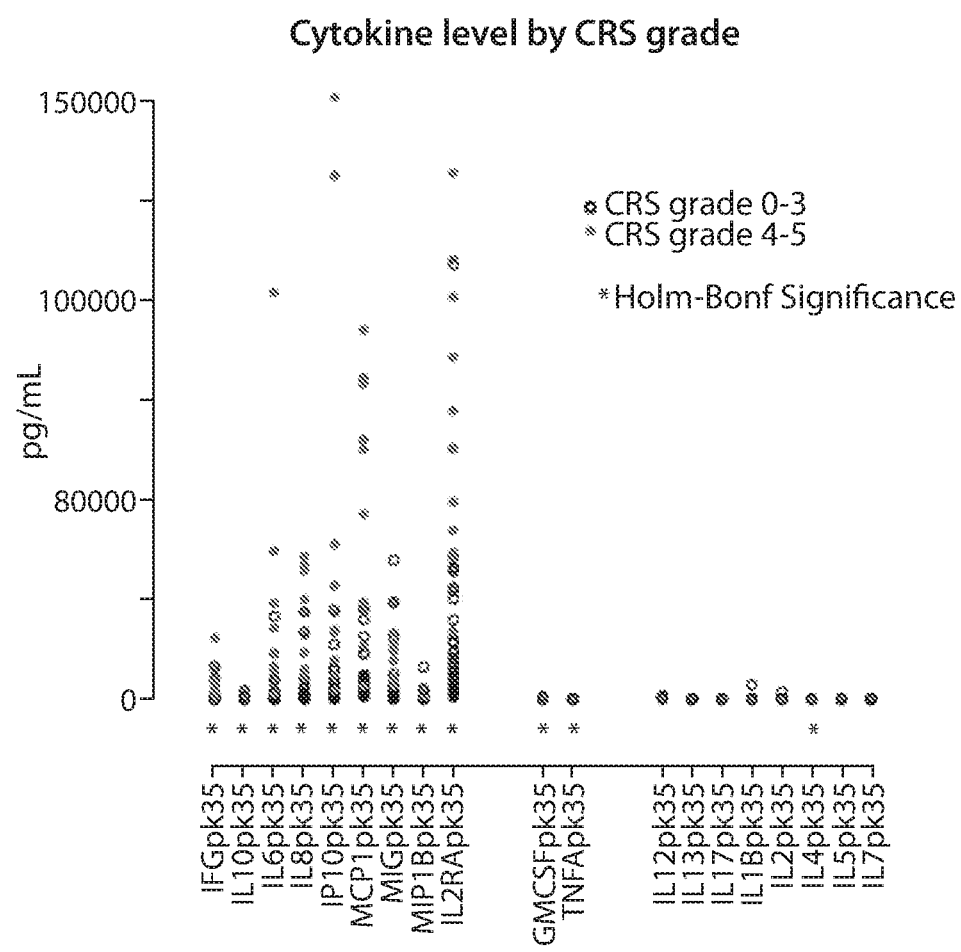
Figure 13B:
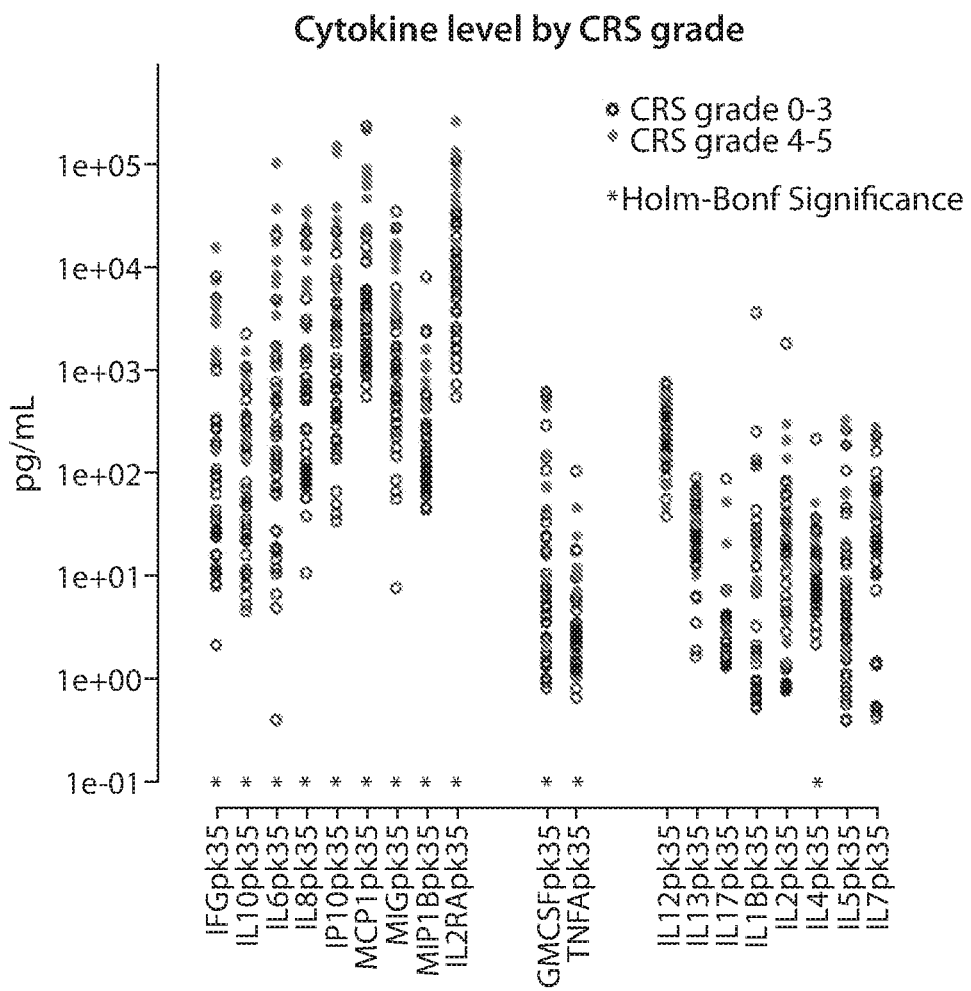

FIGS. 13A and 13B depict cytokines expected to be elevated in HLH (left side of each of FIGS. 13A and 13B), cytokines that are expected to be elevated in some patients with HLH and normal in others (center of each of FIGS. 13A and 13B), and cytokines that are expected to be normal in HLH (right of each of FIGS. 13A and 13B). 19 of the tested cytokines have previously been studied in children macrophage activation syndrome (MAS)/hemophagocytic syndrome (HLH). A near identical pattern of cytokines differentially elevated in HLH were also elevated in patients with CRS4-5 compared with CRS0-3. These figures depict cytokines clustered into three groups. Those on the left, including IFNg, IL10, IL6, IL8, IP10, MCP1, MIP1B, and IL2RA are expected to be elevated in HLH and were also found to be differently elevated in patients with severe CRS. Those in the middle, including TNF-a and GM-CSF have been found to be elevated in some patients with HLH and normal in others. Those on the right are cytokines expected to be normal in HLH. *=statistically significant by Holm's adjustment (FIG. 13A) Data presented in linear scale. (FIG. 13B) Data presented in log 10 scale.

Figure 14:
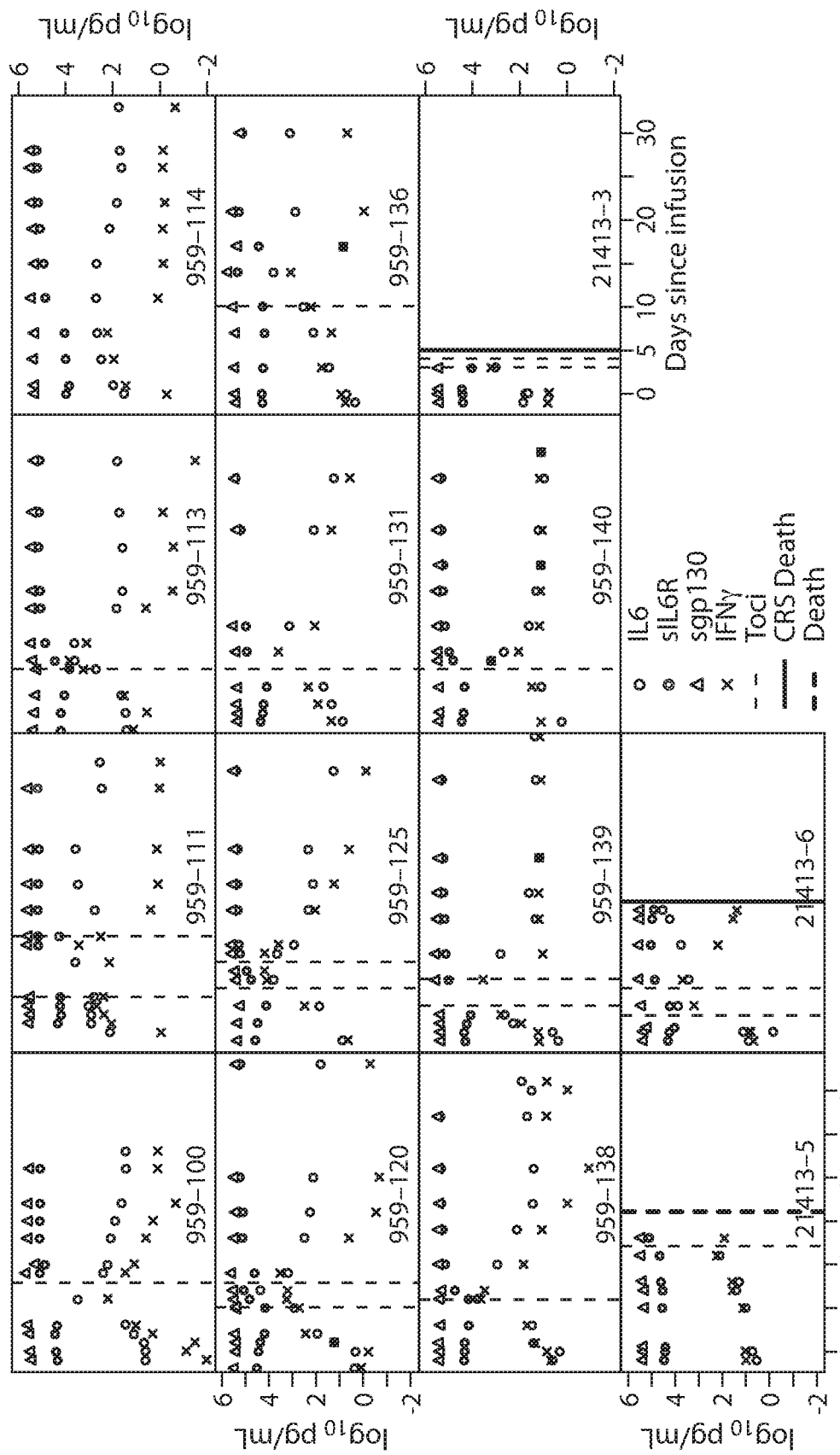

FIG. 14 indicates that tocilizumab improves hypercytokinemia in patients with severe CRS. 14 of 51 patients developed severe CRS and all were treated with tocilizumab. Cytokines were measured serially. This figure depicts the levels of cytokines starting from day of infusion over the first month. Hashed lines depict time of tocilizumab administration. After tocilizumab treatment, there was a transient rise in IL6 (triangles), followed by a rapid decrease. INFγ (x's) also decreased rapidly after tocilizumab administration in most patients. sIL6R increased in all and sgp130 levels increased in most patients after tocilizumab.

Figure 15:
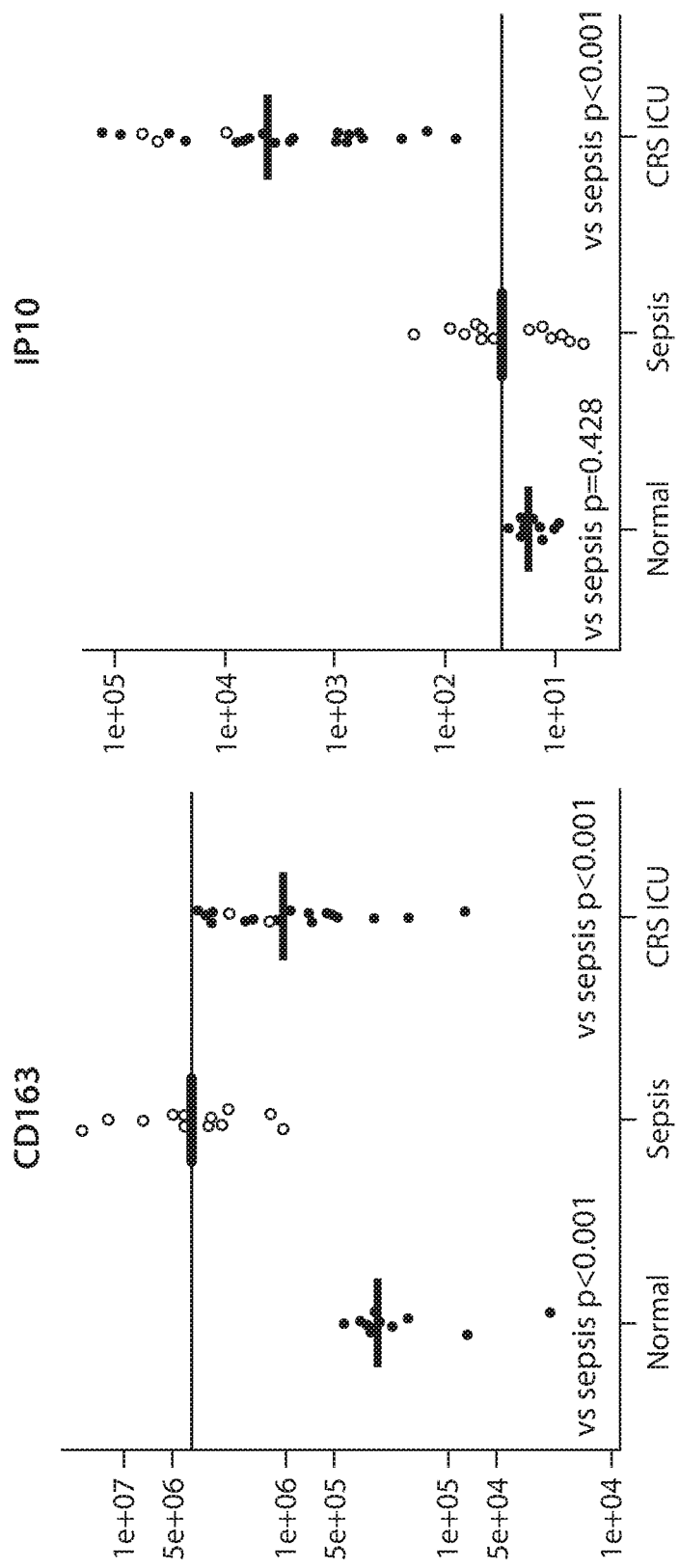

FIG. 15 depicts sCD163 and IP10 in serum from normal donors, pediatric patients at the time of admission to ICU due to sepsis, and ALL patients within 72 hours of admission to ICU due to CRS. Open circles in the CRS cohort indicate patients with sepsis.

Figure 16:
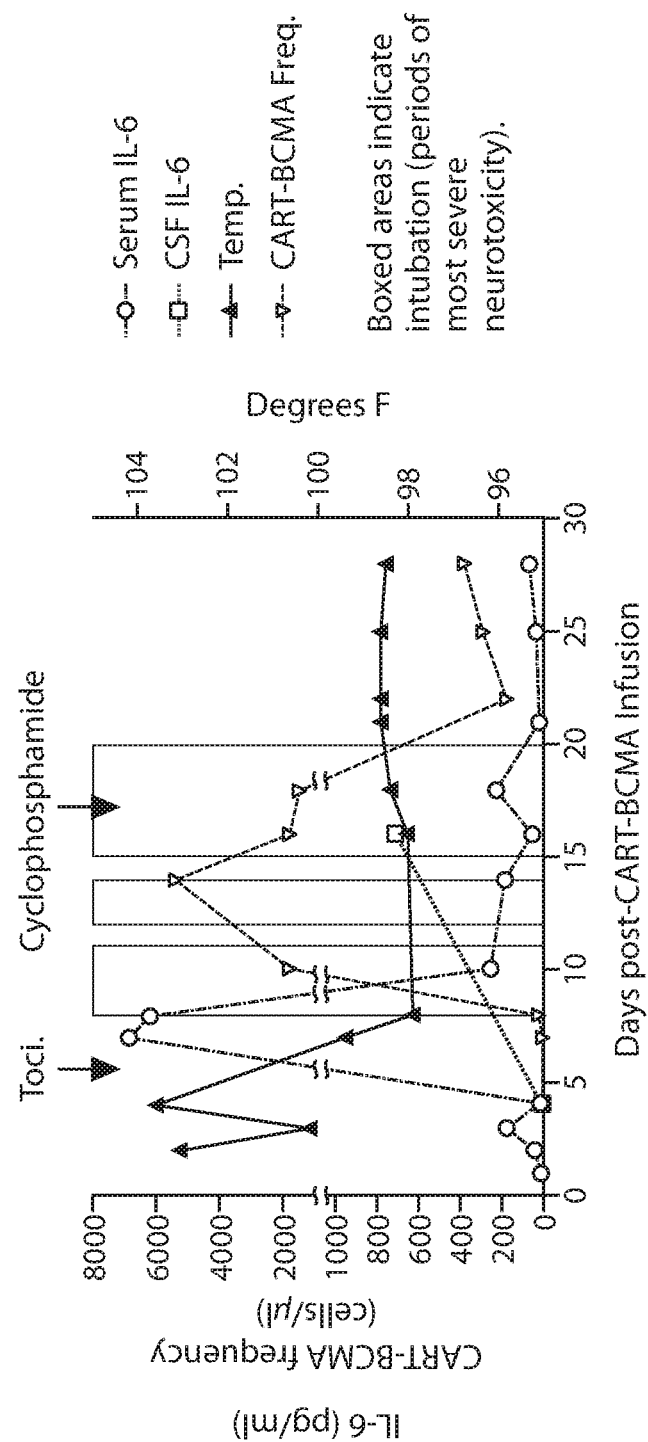

FIG. 16 is a time course depicting serum IL-6 levels, CSF IL-6 levels, patient temperature, and CART-BCMA frequency in a patient experiencing CRS.

DETAILED DESCRIPTION

Cytokine release syndrome (CRS) is a serious and common adverse side effect of immune cell-based therapies, e.g., CAR T cell treatment. Severe CRS is a potentially life-threatening toxicity. Diagnosing and management of CRS in response to immune cell-based therapies is routinely based on clinical parameters and symptoms, e.g., see CRS grading scale as described by Lee, D. et al. (2014) *Blood* 124(2): 188-195. Prior to the present invention, identification of CRS-predictive cytokines or cytokine receptors was particularly challenging in patients with cancer, wherein baseline inflammatory cytokine levels were high due to their underlying disease. Thus, the need exists for identifying biomarkers (e.g., gene products (e.g., polypeptides, gene expression and/or protein expression profiles), or other analytes) predictive of CRS.

The disclosure herein is based, at least in part, on the discovery that several biomarkers can accurately predict CRS early on during the course of a therapy, e.g., an immune cell-based therapy (e.g., a CAR T cell treatment). Such early detection of biomarkers can occur before a subject shows symptoms, or becomes ill, from CRS, e.g., within the first 10, 9, 8, 7, 6, 5, 4, 3, 2, 1 day, or less, of CAR T cell administration). As described herein, 24 cytokines and cytokine receptors, including sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, and GM-CSF, were associated with severe CRS (CRS grades 4-5) compared to less severe CRS (CRS grades 0-3). In some embodiments, two cytokines, sgp130 and IFNγ, were strongly associated with development of severe CRS. In embodiments in adult and pediatric subjects, an accurate early prediction of severe CRS could be made using IFN, sgp130, and IL1Ra. In embodiments in pediatric subjects, an accurate early prediction of severe CRS could be made using IFNγ, IL13, and MIP1α; or using sgp130, IFNγ, and an assessment of disease burden. Still other panels are described herein.

Accordingly, provided herein are methods, systems and kits for evaluating a subject, e.g., predicting a subject's risk of developing CRS (e.g., severe CRS), as well as methods of treating a subject having a cancer comprising evaluating the subject's risk of developing CRS (e.g., severe CRS). The methods described herein advantageously provide an early and accurate identification (e.g., prediction) of which subjects treated with immune cell (e.g., T cell or NK cell) therapies (e.g., CAR T cells) have a high probability of developing severe CRS. As the prediction can be made prior to subjects becoming ill, the methods herein permit early interventions that can reduce morbidity or mortality. The ability to predict which subjects may develop severe CRS prior to its development is helpful in mitigating toxicity. For example, cytokine-directed therapy could be instituted either before the development of CRS or immediately after the development of CRS, but before a subject becomes critically ill. Subjects identified as likely to develop severe CRS can also be more closely monitored to allow early initiation of aggressive supportive care. On the other hand, the ability to predict which subjects are unlikely to develop severe CRS can prevent unnecessary early hospitalization and/or exposure to unneeded cytokine-directed therapy. Therefore, the methods, systems and kits described herein using a small number of cytokines and cytokine receptors to predict severity of CRS with both high sensitivity and specificity are clinically useful, and provide advantages over current treatment modalities.

Definitions

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

"Acquire" or "acquiring" as the terms are used herein, refer to obtaining possession of a physical entity (e.g., a sample, a polypeptide, a nucleic acid, or a sequence), or a value, e.g., a numerical value, by "directly acquiring" or "indirectly acquiring" the physical entity or value. "Directly acquiring" means performing a process (e.g., performing a synthetic or analytical method) to obtain the physical entity or value. "Indirectly acquiring" refers to receiving the physical entity or value from another party or source (e.g., a third party laboratory that directly acquired the physical entity or value). Directly acquiring a physical entity includes performing a process that includes a physical change in a physical substance, e.g., a starting material. Exemplary changes include making a physical entity from two or more starting materials, shearing or fragmenting a substance, separating or purifying a substance, combining two or more separate entities into a mixture, performing a chemical reaction that includes breaking or forming a covalent or non-covalent bond. Directly acquiring a value includes performing a process that includes a physical change in a sample or another substance, e.g., performing an analytical process which includes a physical change in a substance, e.g., a sample, analyte, or reagent (sometimes referred to herein as "physical analysis"), performing an analytical method, e.g., a method which includes one or more of the following: separating or purifying a substance, e.g., an analyte, or a fragment or other derivative thereof, from another substance; combining an analyte, or fragment or other derivative thereof, with another substance, e.g., a buffer, solvent, or reactant; or changing the structure of an analyte, or a fragment or other derivative thereof, e.g., by breaking or forming a covalent or non-covalent bond, between a first and a second atom of the analyte; or by changing the structure of a reagent, or a fragment or other derivative thereof, e.g., by breaking or forming a covalent or non-covalent bond, between a first and a second atom of the reagent.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "altered level of expression" of a biomarker as described herein refers to an increase (or decrease) in the expression level of a marker in a subject, e.g., a sample, such as a sample derived from a patient suffering from cancer (e.g., a hematological cancer such as ALL and CLL) that is greater or less than a reference, e.g., a reference described herein. In embodiments, greater or less is compared to the standard error of the assay employed to assess expression. In embodiments, the alteration can be at least twice, at least twice three, at least twice four, at least twice five, or at least twice ten or more times greater than or less than the expression level of the biomarkers in a control sample (e.g., a sample from a healthy subject not having CRS), or the average expression level in several control samples. An "altered level of expression" can be determined at the protein or nucleic acid (e.g., mRNA) level.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab')$_2$, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3)(see U.S. Pat. No. 6,703,199, which describes fibronectin polypeptide minibodies). The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies in prevention of the occurrence of cancer in the first place. The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "apheresis" as used herein refers to an extracorporeal process by which the blood of a donor or patient is removed from the donor or patient and passed through an apparatus that separates out selected particular constituent(s)

and returns the remainder to the circulation of the donor or patient, e.g., by retransfusion. Thus, in the context of "an apheresis sample" refers to a sample obtained using apheresis.

The term "autologous" refers to any material derived from the same individual to whom it is later to be re-introduced into the individual.

A "biomarker" or "marker" is an analyte, gene, or gene product (e.g., mRNA or protein) that is associated with, or predictive of, a disorder or condition. In one embodiment, a biomarker or marker is associated with CRS. In another embodiment, a biomarker or marker is predictive of CRS. In embodiments, a level or activity of a biomarker is associated with, or predictive of, CRS. In some embodiments, an alteration in level or activity of a biomarker relative to a reference, e.g., a control level or activity, is associated with or predictive of CRS. In embodiments, the level or activity of the biomarker or marker in a sample (e.g., a blood, plasma, or a serum sample) obtained from a subject having cancer, is compared to a control level or activity.

In embodiments, a control level or activity (also called reference level or activity) is the amount and/or activity of a biomarker or marker in a subject, e.g., a biological sample obtained from one or more of: a baseline or prior value for the subject (e.g., prior to treatment with a CAR-expressing cell); the subject at a different time interval; an average or median value for a cancer patient population; a healthy control; or a healthy subject population (e.g., a control), e.g., not having CRS (e.g., severe CRS). In embodiments, a control level of a cytokine or cytokine receptor is the level of the cytokine or cytokine receptor in a normal, healthy subject, e.g., of like age (e.g., adult or pediatric).

The term "associated with" or "association with" refers to a change in one or more biomarkers (e.g., a change in one or more gene products (e.g., mRNA, proteins (e.g., cytokines or cytokine receptors), analytes, or alterations thereof, e.g., mutations or differences in level or amount, e.g., greater or less than a reference) that occurs with a condition, e.g., as a correlation between the biomarker and the condition. The association can be made at any time point (e.g., prior to, during, or after development or onset of the condition). The biomarker need not be causative of the condition, simply present at any point during the timecourse of the condition.

The term "predictive of" refers to a change in one or more biomarkers (e.g., a change in one or more gene products (e.g., mRNA, proteins (e.g., cytokines or cytokine receptors), analytes, or alterations thereof, e.g., mutations or differences in level or amount, e.g., greater or less than a reference) that occurs prior to the development or onset of a condition. In one embodiment, the change occurs prior to the onset of one or more symptoms of CRS, e.g., severe CRS. In one embodiment, a correlation between one or more biomarkers and the condition (e.g., diseases/disorders) is present before the development or the onset of CRS, e.g., severe CRS. In embodiments, a biomarker that is associated with a condition may not be predictive of the condition; a biomarker that is predictive of a condition is an example of a type of association. In embodiments, a biomarker (e.g., biomarker level and/or activity) predictive of a condition such as CRS (e.g., severe CRS) is correlated with CRS (e.g., severe CRS) before development or onset of the CRS (e.g., severe CRS). For example, a biomarker (e.g., biomarker level and/or activity) predictive of CRS (e.g., severe CRS) risk status in a subject not experiencing one or more symptoms of CRS (e.g., severe CRS) can mean that, there is more than a 50% probability (e.g., more than 50%, 60%, 70%, 80%, 90%, or greater probability) that the subject will have a certain form of CRS (e.g., severe CRS).

The term "CRS risk status" refers to the level of risk or the likelihood that a subject has for developing CRS (e.g., severe CRS). In embodiments, the CRS risk status can be a high risk status or a low risk status. In embodiments, a high risk status can mean that there is more than a 50% probability (e.g., more than 50%, 60%, 70%, 80%, 90%, or greater probability) that the subject will develop CRS (e.g., severe CRS). In embodiments, a low risk status can mean that there is more than a 50% probability (e.g., more than 50%, 60%, 70%, 80%, 90%, or greater probability) that the subject will not develop CRS (e.g., severe CRS).

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. Cancers include, but are not limited to, B-cell acute lymphocytic leukemia (B-ALL), T-cell acute lymphocytic leukemia (T-ALL), acute lymphocytic leukemia (ALL), chronic myelogenous leukemia (CML), chronic lymphocytic leukemia (CLL), B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, and Waldenstrom macroglobulinemia. In an embodiment, the cancer is associated with CD19 expression. The terms "tumor" and "cancer" are used interchangeably herein, e.g., both terms encompass solid and liquid tumors. As used herein, the term "cancer" or "tumor" includes premalignant, as well as malignant cancers and tumors.

The terms "cancer associated antigen" or "tumor antigen" interchangeably refers to a molecule (typically protein, carbohydrate or lipid) that is preferentially expressed on the surface of a cancer cell, either entirely or as a fragment (e.g., MHC/peptide), in comparison to a normal cell, and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a cancer-associated antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a cancer-associated antigen is a cell surface molecule that is inappropriately synthesized in the cancer cell, for instance, a molecule that contains deletions, additions or mutations in comparison to the molecule expressed on a normal cell.

As used herein, the term "CD19" refers to the Cluster of Differentiation 19 protein, which is an antigenic determinant detectable on leukemia precursor cells. The human and murine amino acid and nucleic acid sequences can be found in a public database, such as GenBank, UniProt and Swiss-Prot. For example, the amino acid sequence of human CD19 can be found as UniProt/Swiss-Prot Accession No. P15391 and the nucleotide sequence encoding of the human CD19 can be found at Accession No. NM_001178098. As used herein, "CD19" includes proteins comprising mutations, e.g., point mutations, fragments, insertions, deletions and splice variants of full length wild-type CD19. CD19 is expressed on most B lineage cancers, including, e.g., acute lymphoblastic leukemia, chronic lymphocyte leukemia and non-Hodgkin's lymphoma. Other cells which express CD19 are provided below in the definition of "disease associated with expression of CD19." It is also an early marker of B cell progenitors. See, e.g., Nicholson et al., MOL. IMMUN. 34 (16-17): 1157-1165 (1997). In one aspect the antigen-binding portion of the CAR-expressing cell (e.g., T cell, NK cell) recognizes and binds an antigen within the extracellular domain of the CD19 protein. In one aspect, the CD19 protein is expressed on a cancer cell. In one embodiment, the CD19 has a wild-type sequence, e.g., a wild-type human sequence. In another embodiment, the CD19 has a mutant sequence, e.g., a mutant human sequence.

"Chimeric Antigen Receptor" or alternatively a "CAR" refers to a recombinant polypeptide construct comprising at least an extracellular antigen binding domain, a transmembrane domain and a cytoplasmic signaling domain (also referred to herein as "an intracellular signaling domain") comprising a functional signaling domain derived from a stimulatory molecule as defined below. In some embodiments, the domains in the CAR polypeptide construct are in the same polypeptide chain, e.g., comprise a chimeric fusion protein. In some embodiments, the domains in the CAR polypeptide construct are not contiguous with each other, e.g., are in different polypeptide chains, e.g., as provided in an RCAR as described herein.

In one aspect, the stimulatory molecule of the CAR is the zeta chain associated with the T cell receptor complex. In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule is chosen from 4-1BB (i.e., CD137), CD27, ICOS, and/or CD28. In one aspect, the CAR comprises a chimeric fusion protein comprising an extracellular antigen recognition domain, a transmembrane domain and an intracellular signaling domain comprising a functional signaling domain derived from a stimulatory molecule. In one aspect, the CAR comprises a chimeric fusion protein comprising an extracellular antigen recognition domain, a transmembrane domain and an intracellular signaling domain comprising a functional signaling domain derived from a co-stimulatory molecule and a functional signaling domain derived from a stimulatory molecule. In one aspect, the CAR comprises a chimeric fusion protein comprising an extracellular antigen recognition domain, a transmembrane domain and an intracellular signaling domain comprising two functional signaling domains derived from one or more co-stimulatory molecule(s) and a functional signaling domain derived from a stimulatory molecule. In one aspect, the CAR comprises a chimeric fusion protein comprising an extracellular antigen recognition domain, a transmembrane domain and an intracellular signaling domain comprising at least two functional signaling domains derived from one or more co-stimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen recognition domain, wherein the leader sequence is optionally cleaved from the antigen recognition domain (e.g., aa scFv) during cellular processing and localization of the CAR to the cellular membrane. In an embodiment, the CAR is a CD19CAR, e.g., CTL019.

A CAR that comprises an antigen binding domain (e.g., a scFv, a single domain antibody, or TCR (e.g., a TCR alpha binding domain or TCR beta binding domain)) that targets a specific tumor marker X, wherein X can be a tumor marker as described herein, is also referred to as XCAR. For example, a CAR that comprises an antigen binding domain that targets CD19 is referred to as CD19CAR. The CAR can be expressed in any cell, e.g., an immune effector cell as described herein (e.g., a T cell or an NK cell).

The term "signaling domain" refers to the functional portion of a protein which acts by transmitting information within the cell to regulate cellular activity via defined signaling pathways by generating second messengers or functioning as effectors by responding to such messengers.

The portion of the CAR composition comprising an antibody or antibody fragment thereof may exist in a variety of forms where the antigen binding domain is expressed as part of a polypeptide chain, e.g., a contiguous polypeptide chain, including, for example, a single domain antibody fragment (sdAb), a single chain antibody (scFv) and a humanized antibody (Harlow et al., 1999, In: USING ANTIBODIES: A LABORATORY MANUAL, COLD SPRING HARBOR LABORATORY PRESS, NY; Harlow et al., 1989, In: ANTIBODIES: A LABORATORY MANUAL, Cold Spring Harbor, N.Y.; Houston et al., 1988, PROC. NATL. ACAD. SCI. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv. The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273,927-948 ("Chothia" numbering scheme), or a combination thereof.

As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The phrase "disease associated with expression of CD19" includes, but is not limited to, a disease associated with expression of CD19 (e.g., wild type or mutant CD19) or condition associated with cells which express, or at any time expressed, CD19 including, e.g., proliferative diseases such as a cancer or malignancy or a precancerous condition such as a myelodysplasia, a myelodysplastic syndrome or a preleukemia; or a noncancer related indication associated with cells which express CD19. For the avoidance of doubt, a disease associated with expression of CD19 may include a condition associated with cells which do not presently express CD19, e.g., because CD19 expression has been downregulated, e.g., due to treatment with a molecule targeting CD19, e.g., a CD19 CAR, but which at one time expressed CD19. In one aspect, a cancer associated with expression of CD19 is a hematological cancer. In one aspect, the hematological cancer is a leukemia or a lymphoma.

In one aspect, a cancer associated with expression of CD19 includes cancers and malignancies including, but not limited to, e.g., one or more acute leukemias including but not limited to, e.g., B-cell acute lymphocytic leukemia ("B-ALL"), T-cell acute lymphocytic leukemia ("T-ALL"), acute lymphocytic leukemia (ALL); one or more chronic leukemias including but not limited to, e.g., chronic myelogenous leukemia (CML), chronic lymphocytic leukemia (CLL). Additional cancers or hematologic conditions associated with expression of CD19 comprise, but are not limited to, e.g., B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further diseases associated with expression of CD19expression include, but not limited to, e.g., atypical and/or non-classical cancers, malignancies, precancerous conditions or proliferative diseases associated with expression of CD19. Non-cancer related indications associated with expression of CD19 include, but are not limited to, e.g., autoimmune disease, (e.g., lupus), inflammatory disorders (allergy and asthma) and transplantation. In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein. In other embodiments, the disease is a CD19-negative cancer, e.g., a CD19-negative relapsed cancer. In some embodiments, the tumor antigen (e.g., CD19)-expressing cell expresses, or at any time expressed, mRNA encoding the tumor antigen. In an embodiment, the tumor antigen (e.g., CD19)-expressing cell produces the tumor antigen protein (e.g., wild-type or mutant), and the tumor antigen protein may be present at normal levels or reduced levels. In an embodiment, the tumor antigen (e.g., CD19)-expressing cell produced detectable levels of a tumor antigen protein at one point, and subsequently produced substantially no detectable tumor antigen protein.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to an MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain refers to an intracellular portion of a costimulatory molecule. The intracellular signaling domain can comprise the entire intracellular portion, or the entire native intracellular signaling domain, of the molecule from which it is derived, or a functional fragment thereof. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CDS, CD7, CD287, LIGHT, NKG2C, SLAMF7, NKp80, CD160, B7-H3, and a ligand that specifically binds with CD83, and the like.

The term "effector function" refers to a specialized function of a cell. Effector function of a T cell, for example, may be cytolytic activity or helper activity including the secretion of cytokines.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "endogenous" refers to any material from or produced inside an organism, cell, tissue or system.

The term "effective amount" or "therapeutically effective amount" are used interchangeably herein, and refer to an amount of a compound, formulation, material, or composition, as described herein effective to achieve a particular biological result.

The term "exogenous" refers to any material introduced from or produced outside an organism, cell, tissue or system.

The term "expression" refers to the transcription and/or translation of a particular nucleotide sequence driven by a promoter.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)$_n$, where n is a positive integer equal to or greater than 1. For example, n=1, n=2, n=3, n=4, n=5, n=6, n=7, n=8, n=9 and n=10 (SEQ ID NO:28). In one embodiment, the flexible polypeptide linkers include, but are not limited to, (Gly$_4$Ser)$_4$ (SEQ ID NO:29) or (Gly$_4$ Ser)$_3$ (SEQ ID NO:30). In another embodiment, the linkers include multiple repeats of (Gly$_2$Ser), (GlySer) or (Gly$_3$Ser) (SEQ ID NO:31). Also included within the scope of the invention are linkers described in WO2012/138475, incorporated herein by reference.

The terms "homology" or "identity," as used interchangeably herein, refer to sequence similarity between two polynucleotide sequences or between two polypeptide sequences, with identity being a more strict comparison. The phrases "percent identity or homology" and "% identity or homology" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value there between. Identity or similarity can be determined by comparing a position in each sequence that can be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences. The term "substantial homology," as used herein, refers to homology of at least 50%, at least 60%, at least 65%, at least 70%, at least 75%, at least 80%, at least 85%, at least 90%, at least 95% or more.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., NATURE, 321: 522-525, 1986; Reichmann et al., NATURE, 332: 323-329, 1988; Presta, CURR. OP. STRUCT. BIOL., 2: 593-596, 1992.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NK-T) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc No. AAA62478.2, or the equivalent residues from a non-human species, e.g., mouse, rodent, monkey, ape and the like. In one aspect, the "4-1BB costimulatory domain" is the sequence provided as SEQ ID NO:16 or the equivalent residues from a non-human species, e.g., mouse, rodent, monkey, ape and the like.

An "intracellular signaling domain," as the term is used herein, refers to an intracellular portion of a molecule. The intracellular signaling domain can generate a signal that promotes an immune effector function of the CAR containing cell, e.g., a CAR-expressing cell, e.g., a T cell or an NK cell. Examples of immune effector function, e.g., in a CAR-expressing cell include, cytolytic activity and helper activity, including the secretion of cytokines. In embodiments, the intracellular signaling domain is the portion of a protein which transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CAR-expressing cell (e.g., a T cell, an NK cell), a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, CD278 ("ICOS"), FcεRI, CD66d, CD32, DAP10 and DAP12.

As used herein, "in vitro transcribed RNA" refers to RNA, e.g., mRNA, that has been synthesized in vitro. Generally, the in vitro transcribed RNA is generated from an in vitro transcription vector. The in vitro transcription vector comprises a template that is used to generate the in vitro transcribed RNA.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., MOL. THER. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. The dose is insufficient to result in complete immune suppression but is sufficient to enhance the immune response.

The term "nucleic acid" or "polynucleotide" refers to deoxyribonucleic acid (DNA) or ribonucleic acid (RNA), or a combination of a DNA or RNA thereof, and polymers thereof in either single- or double-stranded form. The term "nucleic acid" includes a gene, cDNA or an mRNA. In one embodiment, the nucleic acid molecule is synthetic (e.g., chemically synthesized) or recombinant. Unless specifically limited, the term encompasses nucleic acids containing analogues or derivatives of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., NUCLEIC ACID RES. 19:5081 (1991); Ohtsuka et al., J. BIOL. CHEM. 260:2605-2608 (1985); and Rossolini et al., MOL. CELL. Probes 8:91-98 (1994)). In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

A "nucleic acid marker" or "nucleic acid biomarker" is a nucleic acid (e.g., DNA, mRNA, cDNA) encoded by or corresponding to a marker as described herein. For example, such marker nucleic acid molecules include DNA (e.g., genomic DNA and cDNA) comprising the entire or a partial sequence of any of the nucleic acid sequences set forth, or the complement or hybridizing fragment of such a sequence. The marker nucleic acid molecules also include RNA comprising the entire or a partial sequence of any of the nucleic acid sequences set forth herein, or the complement of such a sequence, wherein all thymidine residues are replaced with uridine residues. A "marker protein" is a protein encoded by or corresponding to a marker of the invention. A marker protein comprises the entire or a partial sequence of a protein encoded by any of the sequences set forth herein, or a fragment thereof. The terms "protein" and "polypeptide" are used interchangeably herein.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

An "overexpression" or "significantly higher level of expression" of the gene products refers to an expression level or copy number in a test sample that is greater than the standard error of the assay employed to assess the level of expression. In embodiments, the overexpression can be at least two, at least three, at least four, at least five, or at least ten or more times the expression level of the gene in a control sample or the average expression level of gene products in several control samples.

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

As used herein, a "poly(A)" is a series of adenosines attached by polyadenylation to the mRNA. In one embodiment of a construct for transient expression, the polyA is between 50 and 5000 (SEQ ID NO: 34) (e.g., 2000; SEQ ID NO: 32), e.g., 64 (SEQ ID NO: 44), e.g., greater than 100 (SEQ ID NO: 53), e.g., greater than 400 (SEQ ID NO: 38). poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

The term "probe" refers to any molecule which is capable of selectively binding to a specifically intended target molecule, for example a marker of the invention. Probes can be either synthesized by one skilled in the art, or derived from appropriate biological preparations. For purposes of detection of the target molecule, probes can be specifically designed to be labeled, as described herein. Examples of molecules that can be utilized as probes include, but are not limited to, RNA, DNA, proteins, antibodies, and organic monomers.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "prophylaxis" as used herein means the prevention of or protective treatment for a disease or disease state.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" as used herein refers to the return of a disease (e.g., cancer) or the signs and symptoms of a disease such as cancer after a period of improvement, e.g., after prior treatment of a therapy, e.g., cancer therapy.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

"Sample," "tissue sample," "patient sample," "patient cell or tissue sample" or "specimen" each refers to a biological sample obtained from a tissue or bodily fluid of a subject or patient. The source of the tissue sample can be solid tissue as from a fresh, frozen and/or preserved organ, tissue sample, biopsy, or aspirate; blood or any blood constituents (e.g., serum, plasma); bodily fluids such as urine, cerebral spinal fluid, whole blood, plasma and serum. The sample can include a non-cellular fraction (e.g., urine, plasma, serum, or other non-cellular body fluid). In one embodiment, the sample is a urine sample. In other embodiments, the body fluid from which the sample is obtained from an individual comprises blood (e.g., whole blood). In an embodiment, the sample is a whole blood sample obtained from the subject. In certain embodiments, the blood can be further processed to obtain plasma or serum. In an embodiment, the sample is an apheresis sample obtained from the blood of the subject. In an embodiment, the sample is a manufactured product sample, e.g., genetically engineered T cells obtained from the blood of the subject, e.g., a manufactured CAR-expressing cell (e.g., T cell, NK cell) product, e.g., a manufactured CD19 CAR-expressing cell product. In another embodiment, the sample contains a tissue, cells (e.g., peripheral blood mononuclear cells (PBMC)). For example, the sample can be a fine needle biopsy sample, an archival sample (e.g., an archived sample with a known diagnosis and/or treatment history), a histological section (e.g., a frozen or formalin-fixed section, e.g., after long term storage), among others. The term sample includes any material obtained and/or derived from a biological sample, including a polypeptide, and nucleic acid (e.g., genomic DNA, cDNA, RNA) purified or processed from the sample. Purification and/or processing of the sample can involve one or more of extraction, concentration, antibody isolation, sorting, concentration, fixation, addition of reagents and the like. The sample can contain compounds that are not naturally intermixed with the tissue in nature such as preservatives, anticoagulants, buffers, fixatives, nutrients, antibiotics or the like.

The term "product" or "manufactured product" as used herein, refers to a manufactured composition comprising a genetically engineered cell (e.g., an immune effector cell), e.g., a population of cells in which a plurality of cells are engineered to express a CAR, e.g., a CAR described herein. A manufactured product can be any genetically engineered immune effector cell (e.g., T cell, NK cell), e.g., genetically engineered immune effector cells obtained from the blood of the subject, e.g., a manufactured CAR-expressing cell product, e.g., a manufactured CD19 CAR-expressing cell product. In an embodiment, a cell (e.g., an immune effector cell) engineered to express a CAR may be obtained from an activated cryopreserved expanded cell population (e.g., an expanded immune effector cell population).

The term "signaling domain" refers to the functional portion of a protein which acts by transmitting information within the cell to regulate cellular activity via defined signaling pathways by generating second messengers or functioning as effectors by responding to such messengers.

The amount of a biomarker, e.g., expression of gene products (e.g., one or more the biomarkers described herein), in a subject is "significantly" higher or lower than the normal amount of a marker, if the amount of the marker is greater or less, respectively, than the normal level by an amount greater than the standard error of the assay employed to assess amount, or at least two, three, four, five, ten or more times that amount. Alternatively, the amount of the marker in the subject can be considered "significantly" higher or lower than the normal amount if the amount is at least about 1.5, two, at least about three, at least about four, or at least about five times, higher or lower, respectively, than the normal amount of the marker.

The term "specifically binds," refers to an antibody, or a ligand, which recognizes and binds with a cognate binding partner protein present in a sample, but which antibody or ligand does not substantially recognize or bind other molecules in the sample.

The term "stimulation," refers to a primary response induced by binding of a stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, such as down regulation of TGF-β, and/or reorganization of cytoskeletal structures, and the like.

The term "stimulatory molecule," refers to a molecule expressed by a T cell that provides the primary cytoplasmic signaling sequence(s) that regulate primary activation of the TCR complex in a stimulatory way for at least some aspect of the T cell signaling pathway. In one aspect, the primary signal is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon Rib), CD3 gamma, CD3 delta, CD3 epsilon, CD79a, CD79b, DAP10, and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:17, or the equivalent residues from a non-human species, e.g., mouse, rodent, monkey, ape and the like. In a specific CAR of the invention, the primary signaling sequence of CD3-zeta is the sequence as provided in SEQ ID NO:30, or the equivalent residues from a non-human species, e.g., mouse, rodent, monkey, ape and the like.

The term "subject" is intended to include living organisms in which an immune response can be elicited (e.g., mammals, human). In an embodiment, a subject is a mammal. In an embodiment, a subject is a human. In an embodiment, a subject is a patient. Examples of subjects include humans, monkeys, chimpanzees, dogs, cats, mice, rats, and transgenic species thereof.

The term "therapeutic" as used herein means a treatment. A therapeutic effect is obtained by reduction, suppression, remission, or eradication of a disease state.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell. In embodiments, a CAR molecule is transiently expressed in a cell, e.g., host cell, for a finite period of time or number of cell replications, e.g., less than 50 days (e.g., less than 40, 30, 25, 20, 15, 10, 5, 4, 3, 2 or fewer days). In one embodiment, transient expression is effected using an in vitro transcribed RNA.

As used herein, "stable" refers to expression of a transgene that is for a longer period than transient expression. In embodiments, the transgene is integrated into the genome of a cell, e.g., a host cell, or contained within a stable plasmid replicon in the cell. In one embodiment, a transgene is integrated into the cell genome using a gene delivery vector, e.g., a retroviral vector such as a lentivirus vector.

The term "transmembrane domain," refers to a polypeptide that spans the plasma membrane. In an embodiment, it links an extracellular sequence, e.g., a switch domain, an extracellular recognition element, e.g., an antigen binding domain, an inhibitory counter ligand binding domain, or costimulatory ECD domain, to an intracellular sequence, e.g., to a switch domain or an intracellular signaling domain. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). Examples of transmembrane domains are disclosed herein.

The terms "treat", "treatment" and "treating" refer to the reduction or amelioration of the progression, severity and/or duration of a proliferative disorder, or the amelioration of one or more symptoms (e.g., one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"- refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

An "underexpression" or "significantly lower level of expression" of products (e.g., the markers set forth herein) refers to an expression level in a test sample that is greater than the standard error of the assay employed to assess expression, for example, at least 1.5, twice, at least three, at least four, at least five, or at least ten or more times less than the expression level of the gene in a control sample, or the average expression level of gene products in several control samples.

The term "xenogeneic" refers to a graft derived from an animal of a different species.

The term "zeta" or alternatively "zeta chain", "CD3-zeta" or "TCR-zeta" is defined as the protein provided as GenBank Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:18 (mutant CD3 zeta). In one aspect, the "zeta stimulatory domain" or a "CD3-zeta stimulatory domain" is the sequence provided as SEQ ID NO:20 (wild-type CD3 zeta).

Various aspects of the invention are described in further detail below. Additional definitions are set out throughout the specification.

Cytokine Release Syndrome (CRS)

Cytokine release syndrome (CRS) is a potentially life-threatening cytokine-associated toxicity that can occur as a result of cancer immunotherapy, e.g., cancer antibody therapies or T cell immunotherapies (e.g., CAR T cells). CRS results from high-level immune activation when large numbers of lymphocytes and/or myeloid cells release inflammatory cytokines upon activation. The severity of CRS and the timing of onset of symptoms can vary depending on the magnitude of immune cell activation, the type of therapy administered, and/or the extent of tumor burden in a subject. In the case of T-cell therapy for cancer, symptom onset is typically days to weeks after administration of the T-cell therapy, e.g., when there is peak in vivo T-cell expansion. See, e.g., Lee et al. Blood. 124.2(2014): 188-95.

Symptoms of CRS can include neurologic toxicity, disseminated intravascular coagulation, cardiac dysfunction, adult respiratory distress syndrome, renal failure, and/or hepatic failure. For example, symptoms of CRS can include fever with or without rigors, fatigue, malaise, myalgias, vomiting, headache, nausea, anorexia, arthalgias, diarrhea, rash, hypoxemia, tachypnea, hypotension, widened pulse pressure, potentially diminished cardiac output (late), increased cardiac output (early), azotemia, hypofibrinogenemia with or without bleeding, elevated D-dimer, hyperbilirubinemia, transaminitis, confusion, delirium, mental status changes, hallucinations, tremor, seizures, altered gait, word finding difficulty, frank aphasia, or dymetria.

IL-6 is thought to be a mediator of CRS toxicity. See, e.g., id. High IL-6 levels may initiate a proinflammatory IL-6 signaling cascade, leading to one or more of the CRS symptoms. IL-6 and sIL-6R levels can be measured, e.g., as described in Chen et al., "Measuring IL-6 and sIL-6R in serum from patients treated with tocilizumab and/or siltuximab following CAR T cell therapy" J Immunol Methods. 2016 July; 434:1-8. doi: 10.1016/j.jim.2016.03.005.

In some cases, the level of C-reactive protein (CRP) (a biomolecule produced by the liver, e.g., in response to IL-6) can be a measure of IL-6 activity. In some cases, CRP levels may increase several fold (e.g., several logs) during CRS. CRP levels can be measured using methods described herein, and/or standard methods available in the art.

CRS Grading

In some embodiments, CRS can be graded in severity from 1-5 as follows. Grades 1-3 are less than severe CRS. Grades 4-5 are severe CRS. For Grade 1 CRS, only symptomatic treatment is needed (e.g., nausea, fever, fatigue, myalgias, malaise, headache) and symptoms are not life threatening. For Grade 2 CRS, the symptoms require moderate intervention and generally respond to moderate intervention. Subjects having Grade 2 CRS develop hypotension that is responsive to either fluids or one low-dose vasopressor; or they develop grade 2 organ toxicity or mild respiratory symptoms that are responsive to low flow oxygen (<40% oxygen). In Grade 3 CRS subjects, hypotension generally cannot be reversed by fluid therapy or one low-dose vasopressor. These subjects generally require more than low flow oxygen and have grade 3 organ toxicity (e.g., renal or cardiac dysfunction or coagulopathy) and/or grade 4 transaminitis. Grade 3 CRS subjects require more aggressive intervention, e.g., oxygen of 40% or higher, high dose vasopressor(s), and/or multiple vasopressors. Grade 4 CRS subjects suffer from immediately life-threatening symptoms, including grade 4 organ toxicity or a need for mechanical ventilation. Grade 4 CRS subjects generally do not have transaminitis. In Grade 5 CRS subjects, the toxicity causes death. Sets of criteria for grading CRS are provided herein as Table 13, Table 15, and Table 16. Unless otherwise specified, CRS as used herein refers to CRS according to the criteria of Table 13.

CRS Therapies

Therapies for CRS include IL-6 inhibitor or IL-6 receptor (IL-6R) inhibitors (e.g., tocilizumab or siltuximab), bazedoxifene, sgp130 blockers, vasoactive medications, corticosteroids, immunosuppressive agents, and mechanical ventilation. Exemplary therapies for CRS are described in International Application WO2014011984, which is hereby incorporated by reference.

Tocilizumab is a humanized, immunoglobulin G1kappa anti-human IL-6R monoclonal antibody. See, e.g., id. Tocilizumab blocks binding of IL-6 to soluble and membrane bound IL-6 receptors (IL-6Rs) and thus inhibitos classical and trans-IL-6 signaling. In embodiments, tocilizumab is administered at a dose of about 4-12 mg/kg, e.g., about 4-8 mg/kg for adults and about 8-12 mg/kg for pediatric subjects, e.g., administered over the course of 1 hour.

In some embodiments, the CRS therapeutic is an inhibitor of IL-6 signalling, e.g., an inhibitor of IL-6 or IL-6 receptor. In one embodiment, the inhibitor is an anti-IL-6 antibody, e.g., an anti-IL-6 chimeric monoclonal antibody such as siltuximab. In other embodiments, the inhibitor comprises a soluble gp130 (sgp130) or a fragment thereof that is capable of blocking IL-6 signalling. In some embodiments, the sgp130 or fragment thereof is fused to a heterologous domain, e.g., an Fc domain, e.g., is a gp130-Fc fusion protein such as FE301. In embodiments, the inhibitor of IL-6 signalling comprises an antibody, e.g., an antibody to the IL-6 receptor, such as sarilumab, olokizumab (CDP6038), elsilimomab, sirukumab (CNTO 136), ALD518/BMS-945429, ARGX-109, or FM101. In some embodiments, the inhibitor of IL-6 signalling comprises a small molecule such as CPSI-2364.

Exemplary vasoactive medications include but are not limited to angiotensin-11, endothelin-1, alpha adrenergic agonists, rostanoids, phosphodiesterase inhibitors, endothelin antagonists, inotropes (e.g., adrenaline, dobutamine, isoprenaline, ephedrine), vasopressors (e.g., noradrenaline, vasopressin, metaraminol, vasopressin, methylene blue), inodilators (e.g., milrinone, levosimendan), and dopamine.

Exemplary vasopressors include but are not limited to norepinephrine, dopamine, phenylephrine, epinephrine, and vasopressin. In some embodiments, a high-dose vasopressor includes one or more of the following: norpepinephrine monotherapy at ≥20 ug/min, dopamine monotherapy at ≥10 ug/kg/min, phenylephrine monotherapy at ≥200 ug/min, and/or epinephrine monotherapy at ≥10 ug/min. In some embodiments, if the subject is on vasopres sin, a high-dose vasopressor includes vasopressin+norepinephrine equivalent of ≥10 ug/min, where the norepinephrine equivalent dose=[norepinephrine (ug/min)]+[dopamine (ug/kg/min)/2]+[epinephrine (ug/min)]+[phenylephrine (ug/min)/10]. In some embodiments, if the subject is on combination vasopressors (not vasopressin), a high-dose vasopressor includes norepinephrine equivalent of ≥20 ug/min, where the norepinephrine equivalent dose=[norepinephrine (ug/min)]+[dopamine (ug/kg/min)/2]+[epinephrine (ug/min)]+[phenylephrine (ug/min)/10]. See e.g., Id.

In some embodiments, a low-dose vasopressor is a vasopressor administered at a dose less than one or more of the doses listed above for high-dose vasopressors.

Exemplary corticosteroids include but are not limited to dexamethasone, hydrocortisone, and methylprednisolone. In embodiments, a dose of dexamethasone of 0.5 mg/kg is used. In embodiments, a maximum dose of dexamethasone of 10 mg/dose is used. In embodiments, a dose of methylprednisolone of 2 mg/kg/day is used.

Exemplary immunosuppressive agents include but are not limited to an inhibitor of TNFα or an inhibitor of IL-1. In embodiments, an inhibitor of TNFα comprises an anti-TNFα antibody, e.g., monoclonal antibody, e.g., infliximab. In embodiments, an inhibitor of TNFα comprises a soluble TNFα receptor (e.g., etanercept). In embodiments, an IL-1 or IL-1R inhibitor comprises anakinra.

In some embodiments, the subject at risk of developing severe CRS is administered an anti-IFN-gamma or anti-sIL2Ra therapy, e.g., an antibody molecule directed against IFN-gamma or sIL2Rα.

In embodiments, for a subject who has received a therapeutic antibody molecule such as blinatumomab and who has CRS or is at risk of developing CRS, the therapeutic antibody molecule is administered at a lower dose and/or a lower frequency, or administration of the therapeutic antibody molecule is halted.

In embodiments, a subject who has CRS or is at risk of developing CRS is treated with a fever reducing medication such as acetaminophen.

In embodiments, a subject herein is administered or provided one or more therapies for CRS described herein, e.g., one or more of IL-6 inhibitors or IL-6 receptor (IL-6R) inhibitors (e.g., tocilizumab), vasoactive medications, corticosteroids, immunosuppressive agents, or mechanical ventilation, in any combination, e.g., in combination with a CAR-expressing cell described herein.

In embodiments, a subject at risk of developing CRS (e.g., severe CRS) (e.g., identified as having a high risk status for developing severe CRS) is administered one or more therapies for CRS described herein, e.g., one or more of IL-6 inhibitor or IL-6 receptor (IL-6R) inhibitors (e.g., tocilizumab), vasoactive medications, corticosteroids, immunosuppressive agents, or mechanical ventilation, in any combination, e.g., in combination with a CAR-expressing cell described herein.

In embodiments, a subject herein (e.g., a subject at risk of developing severe CRS or a subject identified as at risk of developing severe CRS) is transferred to an intensive care unit. In some embodiments, a subject herein (e.g., a subject at risk of developing severe CRS or a subject identified as at risk of developing severe CRS) is monitored for one ore more symptoms or conditions associated with CRS, such as fever, elevated heart rate, coagulopathy, MODS (multiple organ dysfunction syndrome), cardiovascular dysfunction, distributive shock, cardiomyopathy, hepatic dysfunction, renal dysfunction, encephalopathy, clinical seizures, respiratory failure, or tachycardia. In some embodiments, the methods herein comprise administering a therapy for one of the symptoms or conditions associated with CRS. For instance, in embodiments, e.g., if the subject develops coagulopathy, the method comprises administering cryoprecipitate. In some embodiments, e.g., if the subject develops cardiovascular dysfunction, the method comprises administering vasoactive infusion support. In some embodiments, e.g., if the subject develops distributive shock, the method comprises administering alpha-agonist therapy. In some embodiments, e.g., if the subject develops cardiomyopathy, the method comprises administering milrinone therapy. In some embodiments, e.g., if the subject develops respiratory failure, the method comprises performing mechanical ventilation (e.g., invasive mechanical ventilation or noninvasive mechanical ventilation). In some embodiments, e.g., if the subject develops shock, the method comprises administering crystalloid and/or colloid fluids.

In embodiments, the CAR-expressing cell is administered prior to, concurrently with, or subsequent to administration of one or more therapies for CRS described herein, e.g., one or more of IL-6 inhibitor or IL-6 receptor (IL-6R) inhibitors (e.g., tocilizumab), vasoactive medications, corticosteroids, immunosuppressive agents, or mechanical ventilation. In embodiments, the CAR-expressing cell is administered within 2 weeks (e.g., within 2 or 1 week, or within 14 days, e.g., within 14, 13, 12, 11, 10, 9, 8, 7, 6, 5, 4, 3, 2, 1 day or less) of administration of one or more therapies for CRS described herein, e.g., one or more of IL-6 inhibitors or IL-6 receptor (IL-6R) inhibitors (e.g., tocilizumab), vasoactive medications, corticosteroids, immunosuppressive agents, or mechanical ventilation. In embodiments, the CAR-expressing cell is administered at least 1 day (e.g., at least 1, 2, 3, 4, 5, 6, 7, 8, 9, 10, 11, 12, 13, 14, 15, 16, 17, 18, 19, 20, 1, week, 2 weeks, 3 weeks, 4 weeks, 1 month, 2 months, 3 months, 3 months, or more) before or after administration of one or more therapies for CRS described herein, e.g., one or more of IL-6 inhibitors or IL-6 receptor (IL-6R) inhibitors (e.g., tocilizumab), vasoactive medications, corticosteroids, immunosuppressive agents, or mechanical ventilation.

In embodiments, a subject herein (e.g., a subject at risk of developing severe CRS or a subject identified as at risk of developing severe CRS) is administered a single dose of an IL-6 inhibitor or IL-6 receptor (IL-6R) inhibitor (e.g., tocilizumab). In embodiments, the subject is administered a plurality of doses (e.g., 2, 3, 4, 5, 6, or more doses) of an IL-6 inhibitor or IL-6 receptor (IL-6R) inhibitor (e.g., tocilizumab).

In embodiments, a subject at low or no risk of developing CRS (e.g., severe CRS) (e.g., identified as having a low risk status for developing severe CRS) is not administered a therapy for CRS described herein, e.g., one or more of IL-6 inhibitor or IL-6 receptor (IL-6R) inhibitors (e.g., tocilizumab), vasoactive medications, corticosteroids, immunosuppressive agents, or mechanical ventilation.

In embodiments, a subject is determined to be at high risk of developing severe CRS by using an evaluation or prediction method described herein. In embodiments, a subject is determined to be at low risk of developing severe CRS by using an evaluation or prediction method described herein.

Use of Biomarkers to Evaluate (e.g., Predict) CRS Severity

In embodiments, one or more biomarkers are used to evaluate (e.g., predict) CRS severity. Exemplary biomarkers used to evaluate (e.g., predict) CRS severity include cytokines and cytokine receptors such as sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, and GM-CSF. In embodiments, one or more (e.g., two or more, or three or more) of the cytokines and cytokine receptors, sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, and GM-CSF, are used to evaluate (e.g., predict) CRS severity. In embodiments, one or more (e.g., two or more, or three or more) of the cytokines and cytokine receptors, IFN-γ, IL6, IL8, sIL2Rα, sgp130, sIL6R, MCP1, MIP1α, MIP1β, and GM-CSF, are used to evaluate (e.g, predict) CRS severity. In embodiments, one or more (e.g., both) of the cytokines, IFN-γ and sgp130, are used to evaluate (e.g., predict) CRS severity, e.g., in an adult or pediatric subject. In embodiments, one or more (e.g., two or more, or all three) of the cytokines and cytokine receptors, IFN-γ, sgp130, and IL1Ra, are used to evaluate (e.g., predict) CRS severity, e.g., in an adult or pediatric subject. In embodiments, one or more (e.g., two or more, or all three) of the cytokines, IFN-γ, IL13, and MIP1α are used to evaluate (e.g., predict) CRS severity, e.g., in a pediatric subject. In embodiments, one or more (e.g., two or more, or all three) of the cytokines, sgp130, MCP1, and eotaxin are used to evaluate (e.g., predict) CRS severity, e.g., in a pediatric or adult subject. In embodiments, one or more (e.g., two or more, or all three) of the cytokines, IL2, eotaxin, and sgp130 are used to evaluate (e.g., predict) CRS severity, e.g., in a pediatric or adult subject. In embodiments, one or more (e.g., two or more, or all three) of the cytokines, IFN-gamma, IL2, and eotaxin are used to evaluate (e.g., predict) CRS severity, e.g., in a pediatric subject. In embodiments, one or more (e.g., both) of IL10 and disease burden are used to evaluate (e.g., predict) CRS severity, e.g., in a pediatric subject. In embodiments, one or more (e.g., both) of the cytokines, IFN-gamma and IL-13 eotaxin are used to evaluate (e.g., predict) CRS severity, e.g., in a pediatric subject. In embodiments, one or more (e.g., two or more, or all three) of the cytokines, IFN-gamma, IL-13, and MIP1-alpha, are used to evaluate (e.g., predict) CRS severity, e.g., in a pediatric subject. In embodiments, one or more (e.g., both) of the cytokines IFN-gamma and MIP1-alpha, are used to evaluate (e.g., predict) CRS severity, e.g., in a pediatric subject.

Exemplary biomarkers used to evaluate (e.g., predict) CRS severity can also include disease burden assessments, e.g., the extent of disease (e.g., cancer) in a subject. For example, a disease burden assessment can be made by determining the level of disease (e.g., cancer) in a biological sample from a subject (e.g., bone marrow of a subject). For example, a high disease burden is indicated by the presence of at least 25% (e.g., at least 25%, 30%, 35%, 40%, 45%, 50%, 55%, 60%, 70%, 80%, 90% or higher) bone marrow blasts (e.g., determined by morphology on an aspirate or biopsy, a flow assay on an aspirate or biopsy, and/or by MRD). In some embodiments, a high disease burden is indicated by the presence of at least 50% bone marrow blasts. For example, a low disease burden is indicated by the presence of less than 25% (e.g., 24% or less, e.g., 24%, 23%, 22%, 21%, 20%, 15%, 10%, 5% or less) bone marrow blasts (e.g., determined by morphology on an aspirate or biopsy, a flow assay on an aspirate or biopsy, and/or by MRD). In some embodiments, a low disease burden is indicated by the presence of less than 0.1%, 1%, 5%, 25%, or 50% bone marrow blasts. In some embodiments, the cancer is ALL.

In embodiments, one or more cytokines or cytokine receptors in combination with a disease burden assessment is used to evaluate (e.g., predict) CRS severity, e.g., in a pediatric subject. In embodiments, one or more of the cytokines, spg130 and IFN-γ, in combination with bone marrow disease (e.g., cancer) are used to evaluate (e.g., predict) CRS severity, e.g., in a pediatric subject. In embodiments, disease burden assessments, e.g., from bone marrow, e.g., for cancer, can be determined used methods described herein, e.g., as described in Borowitz et al. Blood. 2008; 111(12):5477-85; or Weir et al. Leukemia. 1999; 13(4):558-67.

Another exemplary biomarker used to evaluate (e.g., predict) CRS severity includes C-reactive protein (CRP) level or activity. In embodiments, a subject at low risk of severe CRS is identified as having a CRP level of less than 7 mg/dL (e.g., 7, 6.8, 6, 5, 4, 3, 2, 1 mg/dL or less). In embodiments, a subject at high risk of severe CRS is identified as having a greater level of CRP in a sample (e.g., a blood sample) compared to a subject at low risk of severe CRS or compared to a control level or activity. In embodiments, the greater level or activity is at least 2-fold greater (e.g., at least 2, 3, 4, 5, 6, 7, 8, 9, 10, 15, 20, 25, 30, 40, 50, 100, 500, 1000-fold or more greater) compared to a subject at low risk of severe CRS or compared to a control level or activity.

In embodiments, the biomarkers described herein are used to predict CRS severity in a subject early on after administration with a CAR T cell (e.g., a CAR T cell described herein, e.g., a CD19 CAR-expressing cell therapy described herein such as, e.g., CTL019). In embodiments, the biomarkers described herein are used to predict CRS severity in a subject within 2 weeks, e.g., within 1 week or less after administration with the CAR T cell. In embodiments, the biomarkers described herein are used to predict CRS severity in a subject within 10 days (e.g., 10, 9, 8, 7, 6, 5, 4, 3, 2, 1 day or less after administration with the CAR T cell. In embodiments, the biomarkers described herein are used to predict CRS severity in a subject within 1-10 days (e.g., within 1-10, 1-9, 1-8, 1-7, 1-6, 1-5, 1-4, 1-3, 1-2, or 1 day after administration with the CAR T cell. In embodiments, the biomarkers described herein are used to predict CRS severity in a subject before the subject experiences one or more symptoms of grade 2, 3, 4, or 5 CRS (e.g., before the subject experiences one or more symptoms of grade 3, 4, or 5 CRS, or grade 4 or 5 CRS).

In embodiments, one or more (e.g., both) of the cytokines, IFN-γ and sgp130, are used to predict CRS severity, e.g., in an adult or pediatric subject, within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019).

In embodiments, one or more (e.g., two or more, or all three) of the cytokines and cytokine receptors, IFN-γ, sgp130, and IL1Ra, are used to predict CRS severity, e.g., in an adult or pediatric subject, within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019).

In embodiments, one or more (e.g., two or more, or all three) of the cytokines, IFN-γ, IL13, and MIP1α are used to predict CRS severity, e.g., in a pediatric subject, within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019).

In embodiments, one or more of the cytokines, spg130 and IFN-γ, in combination with bone marrow disease (e.g., cancer) are used to predict CRS severity, e.g., in a pediatric subject, within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019).

In embodiments, CRP level or activity is used to predict CRS severity, e.g., in an adult or pediatric subject, within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019).

In embodiments, elevated or reduced levels of one or more of the cytokines and cytokine receptors described herein, e.g., sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, and GM-CSF, relative to a control level, indicate that the subject is at high risk of developing severe CRS.

In embodiments, levels of one or more of the cytokines or cytokine receptors described herein, e.g., sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, and GM-CSF, that are elevated or lowered relative to a reference level, indicate that the subject is at high risk of developing severe CRS. In embodiments, levels of one or more of the cytokines or cytokine receptors described herein that are elevated by at least 2-fold (e.g., 2, 3, 4, 5, 6, 7, 8, 9, 10, 50, 100, 500, 1000-fold or more) relative to a control level (e.g., a baseline level), indicate that the subject is at high risk of developing severe CRS. In embodiments, levels of one or more of the cytokines or cytokine receptors described herein that are lowered by at least 10% (e.g., at least 20%, 30%, 40%, 50%, 60%, 70%, 80%, 90%, 95%, or 99%) relative to a reference level, indicate that the subject is at high risk of developing severe CRS. In some embodiments, the reference level is a value that does not depend on the baseline level of the cytokine or cytokine receptor in the subject. In some embodiments, the reference level is a level described in Supplemental Table 7 of Teachey et al. Cancer Discov. 2016 June; 6(6):664-79, which is herein incorporated by reference in its entirety, including all the supplemental materials. (baseline cytokine or cytokine receptor values) or Supplemental Table 8 of Teachey et al. (baseline cytokine or cytokine receptor values by disease burden). In some embodiments, the elevated or reduced level of a cytokine or cytokine receptor is a Peak35 value of Supplemental Table 9 of Teachey et al. (Peak35 cytokine or cytokine receptor values in children and adults by grade). In some embodiments, the elevated or reduced value of a cytokine or cytokine receptor is ±10%, 20%, 30%, 40%, 50%, 60%, 70%, 80%, 90%, or 95% of a Peak35 value of Supplemental Table 9 of Teachey et al. In some embodiments, the elevated level of a given cytokine or cytokine receptor is between the median level of that cytokine or cytokine receptor in Supplemental Table 7 of Teachey et al. (as a lower bound) and the highest peak level of that cytokine in Supplemental Table 9 of Teachey et al. (as an upper bound), e.g., the highest peak level in CRS0-3 or CRS4-5 patients in the total cohort. In some embodiments, the elevated level of a given cytokine or cytokine receptor is between the median level of that cytokine or cytokine receptor in Supplemental Table 8 of Teachey et al. (as a lower bound) and the highest peak level of that cytokine or cytokine receptor in Supplemental Table 9 of Teachey et al. (as an upper bound), e.g., the highest peak level in CRS0-3 or CRS4-5 patients in the total cohort. In some embodiments, the reduced level of a given cytokine or cytokine receptor is between the lowest peak level of that cytokine or cytokine receptor in Supplemental Table 9 of Teachey et al. (as a lower bound), e.g., the lowest peak level in CRS0-3 or CRS4-5 patients in the total cohort, and the median level of that cytokine or cytokine receptor in Supplemental Table 7 of Teachey et al. (as an upper bound). In some embodiments, the reduced level of a given cytokine or cytokine receptor is between the lowest peak level of that cytokine or cytokine receptor in Supplemental Table 9 of Teachey et al. (as a lower bound), e.g., the lowest peak level in CRS0-3 or CRS4-5 patients in the total cohort, and the median level of that cytokine or cytokine receptor in Supplemental Table 8 of Teachey et al. (as an upper bound).

In embodiments, levels of one or more of the cytokines or cytokine receptor described herein, e.g., sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, and GM-CSF, that are elevated or lowered relative to a reference level, indicate that the subject is at high risk of developing severe CRS.

In embodiments, levels of one or more (e.g., both) of the cytokines, IFN-γ and sgp130, that are elevated, e.g., by at least 2-fold (e.g., 2, 3, 4, 5, 6, 7, 8, 9, 10, 50, 100, 500, 1000-fold or more) relative to a control level, e.g., when measured within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019), indicate that the subject is at high risk of developing severe CRS, e.g., where the subject is an adult or pediatric subject. In embodiments, the control level is a level of IFN-γ and/or sgp130 of a normal, healthy adult or pediatric subject (e.g., without CRS); or of the subject prior to administration of a CAR-expressing cell.

In embodiments, levels of one or more (e.g., two or more, or all three) of the cytokines or cytokine receptors, IFN-γ, sgp130, and IL1Ra, that are altered, e.g., by at least 2-fold (e.g., 2, 3, 4, 5, 6, 7, 8, 9, 10, 50, 100, 500, 1000-fold or more) relative to a control level, e.g., when measured within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019), indicate that the subject is at high risk of developing severe CRS, e.g., where the subject is an adult or pediatric subject. In embodiments, the altered level is a greater level of sgp130, a greater level of IFN-gamma, or a lower level of IL1Ra, or any combination thereof. In embodiments, the control level is a level of IFN-γ and/or sgp130 of a normal, healthy adult or pediatric subject (e.g., without CRS); or of the subject prior to administration of a CAR-expressing cell.

In embodiments, levels of one or more (e.g., two or more, or all three) of the cytokines, IFN-γ, IL13, and MIP1α, that are altered, e.g., by at least 2-fold (e.g., 2, 3, 4, 5, 6, 7, 8, 9, 10, 50, 100, 500, 1000-fold or more) relative to a control level, e.g., when measured within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019), indicate that the subject is at high risk of developing severe CRS, e.g., where the subject is a pediatric subject. In embodiments, the altered level is a greater level of IFN-gamma, a lower level of IL-13, a lower level of MIP1-alpha, or any combination thereof. In embodiments, the control level is a level of IFN-γ and/or sgp130 of a normal, healthy pediatric subject (e.g., without CRS); or of the subject prior to administration of a CAR-expressing cell.

In embodiments, a combination of altered levels of one or more of the cytokines, spg130 and IFN-γ, relative to a control level, and a high disease burden (e.g., bone marrow disease), e.g., when measured within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019), indicate that the subject is at high risk of developing severe CRS, e.g., where the subject is a pediatric subject. In embodiments, the altered level is a greater level of spg130, a greater level of IFN-gamma, and a greater level of disease burden. In embodiments, the control level is a level of IFN-γ and/or sgp130 of a normal, healthy pediatric subject (e.g., without CRS); or of the subject prior to administration of a CAR-expressing cell.

In embodiments, a CRP level of less than 7 mg/dL (e.g., 7, 6.8, 6, 5, 4, 3, 2, 1 mg/dL or less), e.g., when measured within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019), indicate that the subject is at low risk of developing severe CRS.

In embodiments, a CRP level of 6 mg/dL or greater (e.g., 6, 6.8, 7, 8, 9, 10, 11, 12, 13, 14, 15, 16, 17, 18, 19, 20, 22, 24, 26, 28, 30, 32, 34, 36, 38, 40 mg/dL or greater), e.g., when measured within 1-10 days (e.g., within 1-10, 1-9, 1-8, 1-7, 1-6, 1-5, 1-4, 1-3, 1-2, or 1 day after administration with a CAR T cell (e.g., a CAR T cell described herein, e.g., a CD19 CAR-expressing cell therapy described herein such as, e.g., CTL019), indicate that the subject is at high risk of developing severe CRS.

In certain aspects, the disclosure provides a method of monitoring CRS (e.g., monitoring a patient having CRS0, CRS1, CSR2, or CRS3) or monitoring for the development of severe CRS, comprising evaluating one or more CRS biomarkers herein. The method can involve measuring the one or more biomarkers at a plurality of timepoints, e.g., at 2, 3, 4, 5, 6, 7, 8, 9, 10, or more timepoints. In certain aspects, the disclosure provides a method of managing CRS, comprising evaluating a subject at risk for developing CRS (e.g., severe CRS), and optionally administering a treatment for CRS, e.g., a treatment described herein.

Certain cytokines or cytokine receptors can be referred to by one or more synonynms. For example, IL1R1 and IL1RA, as used herein, are both synonyms for the IL1 receptor. sIL_1RI is a synonym for sILR1. sIL_1RII is a synonym for sIL1R2.

Use of Laboratory Tests to Determine Whether a Subject has Severe CRS

In some aspects, the invention features a method of determining whether a subject has severe CRS. The method includes acquiring a CRS risk status, e.g., in response to an immune cell based therapy, e.g., a CAR-expressing cell therapy (e.g., a CAR19-expressing cell therapy) for the subject, wherein said CRS risk status includes a measure of one, two, or more (all) of the following:

(i) the level or activity of one or more (e.g., 3, 4, 5, 10, 15, 20, or more) cytokines or cytokine receptors chosen from sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, or GM-CSF, or laboratory tests (e.g., analytes) chosen from C-reactive protein (CRP), ferritin, lactate dehydrogenase (LDH), aspartate aminotransferase (AST), or blood urea nitrogen (BUN), alanine aminotransferase (ALT), creatinine (Cr), or fibrinogen, Prothrombin Time (PT), Partial Thromboplastin Time (PTT), or a combination thereof, in a sample (e.g., a blood sample);

(ii) the level or activity of IL6, IL6R, or sgp130, or a combination thereof (e.g., a combination of any two or all three of IL6, IL6R, and sgp130), in a sample (e.g., a blood sample); or (iii) the level or activity of IL6, IFN-gamma, or IL2R, or a combination thereof (e.g., a combination of any two or all three of IL6, IFN-gamma, and IL2R), in a sample (e.g., a blood sample);

wherein the value is indicative of the subject's severe CRS status.

In some embodiments, a ferritin level of at least about 23,500, 25,000, 30,000, 40,000, 50,000, 70,000, 80,000, 90,000, 100,000, 150,000, 200,000, or 250,000 ng/ml, and optionally up to about 299,000 or 412,000 ng/ml, is indicative of severe CRS. In some embodiments, a ferritin level of less than about 23,500, 20,000, 18,000, 16,000, 14,000, 12,000, 10,000, 9,000, 8,000, 7,000, 6,000 5,000, 4,000, 3,000, 2,000, or 1,000 ng/ml and optionally greater than about 280 ng/ml, is indicative that the subject does not have severe CRS.

In some embodiments, a LDH level of at least about 1,700, 2,000, 3,000, 4,000, 5,000, 6,000, 7,000, 8,000, 9,000, 10,000, 15,000, or 20,000 U/L, and optionally up to about 24,000 U/L, is indicative of severe CRS. In some embodiments, a LDH level of less than about 1,700, 1,500, 1,400, 1,300, 1,200, 1,100, 1,000, 900, 800, 700, 600, 500, 400, 300, or 200 U/L, and optionally greater than about 159 U/L, is indicative that the subject does not have severe CRS.

In some embodiments, a CRP level of at least about 20, 21, 22, 23, 24, 25, 26, 27, 28, 29, 30, 31, 32, 33, 34, or 35 mg/dl, and optionally up to about 38 mg/dl, is indicative of severe CRS. In some embodiments, a CRP level of less than about 20, 19, 18, 17, 16, 15, 14, 13, 12, 11, 10, 9, 8, 7, 6, 5, 4, 3, 2, or 1 mg/dl, and optionally greater than about 0.7 mg/dl, is indicative that the subject does not have severe CRS.

In some embodiments, an ALT level of at least about 100, 110, 120, 130, 140, 150, 160, 170, 180, 190, 200, 250, 300, 350, 400, 450, 500, 550, 600, 650, 700, 750, 800, 980, 900, 950, or 1000 U/L, and optionally up to 1300 U/L, is indicative of severe CRS. In some embodiments, an ALT level of less than about 100, 90, 80, 70, 60, 50, 40, or 30 U/L, and optionally greater than about 25 U/L, is indicative that the subject does not have severe CRS.

In some embodiments, an AST level of at least about 150, 200, 250, 300, 350, 400, 450, 500, 550, 600, 650, 700, 750, 800, 980, 900, 950, 1000 U/L, and optionally up to about 1500 U/L, is indicative of severe CRS. In some embodiments, an AST level of less than about 150, 140, 130, 120, 100, 90, 80, 70, 60, 50, 40, or 30 U/L, and optionally greater than about 15 U/L, is indicative that the subject does not have severe CRS.

In some embodiments, a BUN level of at least about 18, 19, 20, 25, 30, 35, 40, 45, 50, 60, 70, 80, 90, 100, 110, 120, 130, 140, 150, 160, 170, 180, or 190 mg/dl, and optionally up to about 210 mg/dl, is indicative of severe CRS. In some embodiments, a BUN level of less than about 18, 17, 16, 15, 14, 13, 12, 11, or 10 mg/dl, and optionally greater than about 5 mg/dl, is indicative that the subject does not have severe CRS.

In some embodiments, a fibrinogen level of less than about 150, 140, 130, 120, 110, 100, 90, 80, 70, 60, 50, 40, or 30 mg/dl, and optionally greater than about 20 mg/dl, is indicative of severe CRS. In some embodiments, a fibrinogen level of at least about 150, 160, 170, 180, 190, 200, or 210 mg/dl, and optionally up to about 230 mg/dl, is indicative that the subject does not have severe CRS.

In some embodiments, a PT level of at least about 17, 18, 19, 20, 21, or 22 sec, and optionally up to about 24 sec, is indicative of severe CRS. In some embodiments, a PT level of less than about 17, 16, 15, or 14 sec, and optionally greater than about 12 sec, is indicative that the subject does not have severe CRS.

In some embodiments, a PTT level of at least about 44, 45, 46, 47, 48, 49, 50, 51, 52, 53, 54, 55, 60, 65, 70, 75, 80, or 85 sec, and optionally up to about 95 sec, indicative of severe CRS. In some embodiments, a PTT level of less than about 44, 43, 42, 41, 40, 39, 38, 37, 36, 35, 34, 33, 32, 31, 30, 29, 28, or 27 sec, and optionally greater than about 25 sec, is indicative that the subject does not have severe CRS.

In some embodiments, a patient with severe CRS has an IFN-γ>75 pg/ml and IL-10>60 pg/ml. In some embodiments, a patient with severe CRS has an IFN-γ of greater than or equal to 40, 50, 60, 70, or 75 pg/ml, an IL-10 level of greater than or equal to 30, 40, 50, or 60 pg/ml, or any combination thereof.

Subjects

For any of the methods and kits disclosed herein, the subject treated, or the subject evaluated, is a subject having, or at risk of having, cancer at any stage of treatment. Exemplary cancers include, but are not limited to, B-cell acute lymphocytic leukemia (B-ALL), T-cell acute lymphocytic leukemia (T-ALL), acute lymphocytic leukemia (ALL), chronic myelogenous leukemia (CML), chronic lymphocytic leukemia (CLL), B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, and Waldenstrom macroglobulinemia. In an embodiment, the cancer is a hematological cancer. In an embodiment, the cancer is ALL. In an embodiment, the cancer is CLL. In an embodiment, the cancer is associated with CD19 expression.

In other embodiments, for any of the methods and kits disclosed herein, the subject treated, or the subject evaluated, is a subject to be treated or who has been treated with a CAR T cell, e.g., a CD19 CAR-expressing cell, e.g., CTL-019.

In embodiments, the subject is an adult subject, e.g., having an age of greater than 18 years (e.g., 18, 19, 20, 21, 22, 23, 24, 25, 26, 27, 28, 29, 30, years of age or older, 30-35, 35-40, 40-45, 45-50, 50-55, 55-60, 60-65, 65-70, 70-75, 75-80, 80-85, 85-90, 90-95, or 95-100 years of age).

In embodiments, the subject is a pediatric subject, e.g., having an age less than 18 (e.g., 17, 16, 15, 14, 13, 12, 11, 10, 9, 8, 7, 6, 5, 4, 3, 2, or 1 year of age or younger).

In embodiments, the subject is at risk (e.g., at high risk) for developing CRS (e.g., severe CRS). In embodiments, the subject is at low risk (e.g., not at risk) for developing CRS (e.g., severe CRS).

In embodiments, the subject has CRS0, CRS1, CRS2, or CRS3.

In embodiments, the risk of a subject for developing CRS (e.g., severe CRS) is determined using an evaluation or prediction method described herein.

Biomarkers Assessment

In some embodiments, the amount of the biomarker determined in a sample from a subject is quantified as an absolute measurement (e.g., ng/mL). Absolute measurements can easily be compared to a reference value or cut-off value. For example, a cut-off value can be determined that represents a disease progressing status; any absolute values falling either above (i.e., for biomarkers that increase expression with progression of a cancer, e.g., a hematological cancer such as ALL and CLL) or falling below (i.e., for biomarkers with decreased expression with progression of a cancer, e.g., a hematological cancer such as ALL and CLL) the cut-off value are likely to be disease progressing.

Alternatively, the relative amount of a biomarker is determined. In one embodiment, the relative amount is determined by comparing the expression and/or activity of one or more biomarkers in a subject with cancer to the expression of the biomarkers in a reference parameter. In some embodiments, a reference parameter is obtained from one or more of: a baseline or prior value for the subject, the subject at a different time interval, an average or median value for a cancer subject (e.g., patient) population, a healthy control, or a healthy subject population.

The present disclosure also pertains to the field of predictive medicine in which diagnostic assays, pharmacogenomics, and monitoring clinical trials are used for predictive purposes to thereby treat an individual prophylactically. Accordingly, one aspect of the present disclosure relates to assays for determining the amount, structure, and/or activity of polypeptides or nucleic acids corresponding to one or more markers described herein, in order to determine whether an individual having cancer (e.g., a hematological cancer such as CLL and ALL) or at risk of developing cancer (e.g., a hematological cancer such as CLL and ALL) will be more likely to respond to CAR-expressing cell therapy (e.g., a CD19 CAR-expressing cell therapy described herein such as, e.g., CTL019).

Methods for Detection of Gene Expression

Biomarker expression level can also be assayed. Expression of a marker described herein can be assessed by any of a wide variety of known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In certain embodiments, activity of a particular gene is characterized by a measure of gene transcript (e.g., mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

Methods of detecting and/or quantifying the gene transcript (mRNA or cDNA made therefrom) using nucleic acid hybridization techniques are known to those of skill in the art (see e.g., Sambrook et al. supra). For example, one method for evaluating the presence, absence, or quantity of cDNA involves a Southern transfer as described above. Briefly, the mRNA is isolated (e.g., using an acid guanidinium-phenol-chloroform extraction method, Sambrook et al. supra.) and reverse transcribed to produce cDNA. The cDNA is then optionally digested and run on a gel in buffer and transferred to membranes. Hybridization is then carried out using the nucleic acid probes specific for the target cDNA.

A general principle of such diagnostic and prognostic assays involves preparing a sample or reaction mixture that can contain a marker, and a probe, under appropriate conditions and for a time sufficient to allow the marker and probe to interact and bind, thus forming a complex that can be removed and/or detected in the reaction mixture. These assays can be conducted in a variety of ways.

For example, one method to conduct such an assay would involve anchoring the marker or probe onto a solid phase support, also referred to as a substrate, and detecting target marker/probe complexes anchored on the solid phase at the end of the reaction. In one embodiment of such a method, a sample from a subject, which is to be assayed for presence and/or concentration of marker, can be anchored onto a carrier or solid phase support. In another embodiment, the reverse situation is possible, in which the probe can be anchored to a solid phase and a sample from a subject can be allowed to react as an unanchored component of the assay.

In order to conduct assays with the above-mentioned approaches, the non-immobilized component is added to the solid phase upon which the second component is anchored. After the reaction is complete, uncomplexed components can be removed (e.g., by washing) under conditions such that any complexes formed will remain immobilized upon the solid phase. The detection of marker/probe complexes anchored to the solid phase can be accomplished in a number of methods outlined herein.

In another embodiment, the probe, when it is the unanchored assay component, can be labeled for the purpose of detection and readout of the assay, either directly or indirectly, with detectable labels discussed herein and which are well-known to one skilled in the art.

It is also possible to directly detect marker/probe complex formation without further manipulation or labeling of either component (marker or probe), for example by utilizing the technique of fluorescence energy transfer (see, for example, Lakowicz et al., U.S. Pat. No. 5,631,169; Stavrianopoulos, et al., U.S. Pat. No. 4,868,103). A fluorophore label on the first, 'donor' molecule is selected such that, upon excitation with incident light of appropriate wavelength, its emitted fluorescent energy will be absorbed by a fluorescent label on a second 'acceptor' molecule, which in turn is able to fluoresce due to the absorbed energy. Alternately, the 'donor' protein molecule can simply utilize the natural fluorescent energy of tryptophan residues. Labels are chosen that emit different wavelengths of light, such that the 'acceptor' molecule label can be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determination of the ability of a probe to recognize a marker can be accomplished without labeling either assay component (probe or marker) by utilizing a technology such as real-time Biomolecular Interaction Analysis (BIA) (see, e.g., Sjolander, S. and Urbaniczky, C., 1991, ANAL. CHEM. 63:2338-2345 and Szabo et al., 1995, CURR. OPIN. STRUCT. BIOL. 5:699-705). As used herein, "BIA" or "surface plasmon resonance" is a technology for studying biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Alternatively, in another embodiment, analogous diagnostic and prognostic assays can be conducted with marker and probe as solutes in a liquid phase. In such an assay, the complexed marker and probe are separated from uncomplexed components by any of a number of standard techniques, including but not limited to: differential centrifugation, chromatography, electrophoresis and immunoprecipitation. In differential centrifugation, marker/probe complexes can be separated from uncomplexed assay components through a series of centrifugal steps, due to the different sedimentation equilibria of complexes based on their different sizes and densities (see, for example, Rivas, G., and Minton, A. P., 1993, *Trends Biochem Sci.* 18(8):284-7). Standard chromatographic techniques can also be utilized to separate complexed molecules from uncomplexed ones. For example, gel filtration chromatography separates molecules based on size, and through the utilization of an appropriate gel filtration resin in a column format, for example, the relatively larger complex can be separated from the relatively smaller uncomplexed components. Similarly, the relatively different charge properties of the marker/probe complex as compared to the uncomplexed components can be exploited to differentiate the complex from uncomplexed components, for example, through the utilization of ion-exchange chromatography resins. Such resins and chromatographic techniques are well known to one skilled in the art (see, e.g., Heegaard, N. H., 1998, J. MOL. RECOGNIT. Winter 11(1-6):141-8; Hage, D. S., and Tweed, S. A. J CHROMATOGR B BIOMED SCI APPL 1997 Oct. 10; 699(1-2):499-525). Gel electrophoresis can also be employed to separate complexed assay components from unbound components (see, e.g., Ausubel et al., ed., CURRENT PROTOCOLS IN MOLECULAR BIOLOGY, John Wiley & Sons, New York, 1987-1999). In this technique, protein or nucleic acid complexes are separated based on size or charge, for example. In order to maintain the binding interaction during the electrophoretic process, non-denaturing gel matrix materials and conditions in the absence of reducing agent are typical. Appropriate conditions to the particular assay and components thereof will be well known to one skilled in the art.

In a particular embodiment, the level of mRNA corresponding to the marker can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., CURRENT PROTOCOLS IN MOLECULAR BIOLOGY, John Wiley & Sons, New York 1987-1999). Additionally, large numbers of tissue samples can readily be processed using techniques well known to those of skill in the art, such as, for example, the single-step RNA isolation process of Chomczynski (1989, U.S. Pat. No. 4,843,155).

The isolated nucleic acid can be used in hybridization or amplification assays that include, but are not limited to, Southern or Northern analyses, polymerase chain reaction analyses and probe arrays. One diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding a marker of the present invention. Other suitable probes for use in the diagnostic assays are described herein. Hybridization of an mRNA with the probe indicates that the marker in question is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in an Affymetrix gene chip array. A skilled artisan can readily adapt known mRNA detection methods for use in detecting the level of mRNA encoded by the markers described herein.

The probes can be full length or less than the full length of the nucleic acid sequence encoding the protein. Shorter probes are empirically tested for specificity. Exemplary nucleic acid probes are 20 bases or longer in length (See, e.g., Sambrook et al. for methods of selecting nucleic acid probe sequences for use in nucleic acid hybridization). Visualization of the hybridized portions allows the qualitative determination of the presence or absence of cDNA.

An alternative method for determining the level of a transcript corresponding to a marker of the present invention in a sample involves the process of nucleic acid amplification, e.g., by rtPCR (the experimental embodiment set forth in Mullis, 1987, U.S. Pat. No. 4,683,202), ligase chain reaction (Barany, 1991, *Proc. Natl. Acad. Sci. USA*, 88:189-193), self-sustained sequence replication (Guatelli et al., 1990, PROC. NATL. ACAD. SCI. *USA* 87:1874-1878), transcriptional amplification system (Kwoh et al., 1989, PROC. NATL. ACAD. SCI. USA 86:1173-1177), Q-Beta Replicase (Lizardi et al., 1988, BIO/TECHNOLOGY 6:1197), rolling circle replication (Lizardi et al., U.S. Pat. No. 5,854,033) or any other nucleic acid amplification method, followed by the detection of the amplified molecules using techniques well known to those of skill in the art. Fluorogenic rtPCR can also be used in the methods of the invention. In fluorogenic rtPCR, quantitation is based on amount of fluorescence signals, e.g., TaqMan and sybr green. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the cells prior to detection. In such methods, a cell or tissue sample is prepared/processed using a histological method. The sample is then immobilized on a support, typically a glass slide, and then contacted with a probe that can hybridize to mRNA that encodes the marker.

As an alternative to making determinations based on the absolute expression level of the marker, determinations can be based on the normalized expression level of the marker. Expression levels are normalized by correcting the absolute expression level of a marker by comparing its expression to the expression of a gene that is not a marker, e.g., a housekeeping gene that is constitutively expressed. Suitable genes for normalization include housekeeping genes such as the actin gene, or epithelial cell-specific genes. This normalization allows the comparison of the expression level in one sample, e.g., a subject sample, to another sample, e.g., a healthy subject, or between samples from different sources.

Alternatively, the expression level can be provided as a relative expression level. To determine a relative expression level of a marker, the level of expression of the marker is determined for 10 or more samples of normal versus cancer isolates, or even 50 or more samples, prior to the determination of the expression level for the sample in question. The mean expression level of each of the genes assayed in the larger number of samples is determined and this is used as a baseline expression level for the marker. The expression level of the marker determined for the test sample (absolute level of expression) is then divided by the mean expression value obtained for that marker. This provides a relative expression level.

In certain embodiments, the samples used in the baseline determination will be from samples derived from a subject having cancer (e.g., a hematological cancer such as ALL and CLL) versus samples from a healthy subject of the same tissue type. The choice of the cell source is dependent on the use of the relative expression level. Using expression found in normal tissues as a mean expression score aids in validating whether the marker assayed is specific to the tissue from which the cell was derived (versus normal cells). In addition, as more data is accumulated, the mean expression value can be revised, providing improved relative expression values based on accumulated data. Expression data from normal cells provides a means for grading the severity of the cancer disease state.

In another embodiment, expression of a marker is assessed by preparing genomic DNA or mRNA/cDNA (i.e., a transcribed polynucleotide) from cells in a subject sample, and by hybridizing the genomic DNA or mRNA/cDNA with a reference polynucleotide which is a complement of a polynucleotide comprising the marker, and fragments thereof. cDNA can, optionally, be amplified using any of a variety of polymerase chain reaction methods prior to hybridization with the reference polynucleotide. Expression of one or more markers can likewise be detected using quantitative PCR (QPCR) to assess the level of expression of the marker(s). Alternatively, any of the many known methods of detecting mutations or variants (e.g., single nucleotide polymorphisms, deletions, etc.) of a marker of the invention can be used to detect occurrence of a mutated marker in a subject.

In a related embodiment, a mixture of transcribed polynucleotides obtained from the sample is contacted with a substrate having fixed thereto a polynucleotide complementary to or homologous with at least a portion (e.g., at least 7, at least 10, at least 15, at least 20, at least 25, at least 30, at least 40, at least 50, at least 100, at least 500, or more nucleotide residues) of a marker described herein. If polynucleotides complementary to, or homologous with, a marker described herein are differentially detectable on the substrate (e.g., detectable using different chromophores or fluorophores, or fixed to different selected positions), then the levels of expression of a plurality of markers can be assessed simultaneously using a single substrate (e.g., a "gene chip" microarray of polynucleotides fixed at selected positions). When a method of assessing marker expression is used which involves hybridization of one nucleic acid with another, the hybridization can be performed under stringent hybridization conditions.

In another embodiment, a combination of methods to assess the expression of a marker is utilized.

Because the compositions, kits, and methods can rely on detection of a difference in expression levels of one or more markers described herein, in certain embodiments the level of expression of the marker is significantly greater than the minimum detection limit of the method used to assess expression in at least one of a biological sample from a subject with cancer (e.g., a hematological cancer such as ALL and CLL) or a reference (e.g., a biological sample from a healthy subject, e.g., a subject without cancer).

Nucleic Acid Molecules and Probes

One aspect of the disclosure pertains to isolated nucleic acid molecules that correspond to one or more markers described herein, including nucleic acids which encode a polypeptide corresponding to one or more markers described herein or a portion of such a polypeptide. The nucleic acid molecules include those nucleic acid molecules which reside in genomic regions identified herein. Isolated nucleic acid molecules also include nucleic acid molecules sufficient for use as hybridization probes to identify nucleic acid molecules that correspond to a marker described herein, including nucleic acid molecules which encode a polypeptide corresponding to a marker described herein, and fragments of such nucleic acid molecules, e.g., those suitable for use as PCR primers for the amplification or mutation of nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded; in certain embodiments the nucleic acid molecule is double-stranded DNA.

An "isolated" nucleic acid molecule is one which is separated from other nucleic acid molecules which are present in the natural source of the nucleic acid molecule. In certain embodiments, an "isolated" nucleic acid molecule is free of sequences (such as protein-encoding sequences) which naturally flank the nucleic acid (i.e., sequences located at the 5' and 3' ends of the nucleic acid) in the genomic DNA of the organism from which the nucleic acid is derived.

The language "substantially free of other cellular material or culture medium" includes preparations of nucleic acid molecule in which the molecule is separated from cellular components of the cells from which it is isolated or recombinantly produced. Thus, nucleic acid molecule that is substantially free of cellular material includes preparations of nucleic acid molecule having less than about 30%, less than about 20%, less than about 10%, or less than about 5% (by dry weight) of other cellular material or culture medium.

If so desired, a nucleic acid molecule, e.g., the marker gene products identified herein, can be isolated using standard molecular biology techniques and the sequence information in the database records described herein. Using all or a portion of such nucleic acid sequences, nucleic acid molecules can be isolated using standard hybridization and cloning techniques (e.g., as described in Sambrook et al., ed., MOLECULAR CLONING: A LABORATORY MANUAL, 2nd ed., Cold Spring Harbor Laboratory Press, Cold Spring Harbor, N.Y., 1989).

A nucleic acid molecule can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule of the invention can be prepared by standard synthetic techniques, e.g., using an automated DNA synthesizer.

Probes based on the sequence of a nucleic acid molecule of the invention can be used to detect transcripts (e.g., mRNA) or genomic sequences corresponding to one or more markers described herein. The probe comprises a label group attached thereto, e.g., a radioisotope, a fluorescent compound, an enzyme, or an enzyme co-factor. Such probes can be used as part of a diagnostic test kit for identifying cells or tissues which mis-express the protein, such as by measuring levels of a nucleic acid molecule encoding the protein in a sample of cells from a subject, e.g., detecting mRNA levels or determining whether a gene encoding the protein has been mutated or deleted.

Polypeptide Detection

Methods to measure biomarkers described herein, include, but are not limited to: Western blot, immunoblot, enzyme-linked immunosorbant assay (ELISA), radioimmunoassay (RIA), immunoprecipitation, surface plasmon resonance, chemiluminescence, fluorescent polarization, phosphorescence, immunohistochemical analysis, liquid chromatography mass spectrometry (LC-MS), matrix-assisted laser desorption/ionization time-of-flight (MALDI-TOF) mass spectrometry, microcytometry, microarray, microscopy, fluorescence activated cell sorting (FACS), flow cytometry, laser scanning cytometry, hematology analyzer and assays based on a property of the protein including but not limited to DNA binding, ligand binding, or interaction with other protein partners.

The activity or level of a marker protein can also be detected and/or quantified by detecting or quantifying the expressed polypeptide. The polypeptide can be detected and quantified by any of a number of means well known to those of skill in the art. These can include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, immunohistochemistry and the like. A skilled artisan can readily adapt known protein/antibody detection methods for use in determining the expression level of one or more biomarkers in a serum sample.

Another agent for detecting a polypeptide is an antibody capable of binding to a polypeptide corresponding to a marker described herein, e.g., an antibody with a detectable label. Antibodies can be polyclonal or monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

In another embodiment, the antibody is labeled, e.g., a radio-labeled, chromophore-labeled, fluorophore-labeled, or enzyme-labeled antibody. In another embodiment, an antibody derivative (e.g., an antibody conjugated with a substrate or with the protein or ligand of a protein-ligand pair {e.g., biotin-streptavidin}), or an antibody fragment (e.g., a single-chain antibody, an isolated antibody hypervariable domain, etc.) which binds specifically with a protein corresponding to the marker, such as the protein encoded by the open reading frame corresponding to the marker or such a protein which has undergone all or a portion of its normal post-translational modification, is used.

Proteins from cells can be isolated using techniques that are well known to those of skill in the art. The protein isolation methods employed can, for example, be such as those described in Harlow and Lane (Harlow and Lane, 1988, *Antibodies: A Laboratory Manual*, Cold Spring Harbor Laboratory Press, Cold Spring Harbor, N.Y.).

In one format, antibodies, or antibody fragments, can be used in methods such as Western blots or immunofluorescence techniques to detect the expressed proteins. In such uses, one can immobilize either the antibody or proteins on a solid support. Suitable solid phase supports or carriers include any support capable of binding an antigen or an antibody. Suitable supports or carriers include glass, polystyrene, polypropylene, polyethylene, dextran, nylon, amylases, natural and modified celluloses, polyacrylamides, gabbros, and magnetite.

In another embodiment, the polypeptide is detected using an immunoassay. As used herein, an immunoassay is an assay that utilizes an antibody to specifically bind to the analyte. The immunoassay is thus characterized by detection of specific binding of a polypeptide to an anti-antibody as opposed to the use of other physical or chemical properties to isolate, target, and quantify the analyte.

The polypeptide is detected and/or quantified using any of a number of well recognized immunological binding assays (see, e.g., U.S. Pat. Nos. 4,366,241; 4,376,110; 4,517,288; and 4,837,168). For a review of the general immunoassays, see also Asai (1993) *Methods in Cell Biology Volume 37: Antibodies in Cell Biology*, Academic Press, Inc. New York; Stites & Terr (1991) *Basic and Clinical Immunology* 7th Edition.

In another embodiment, the polypeptide is detected and/or quantified using Luminex® assay technology. The Luminex® assay separates tiny color-coded beads into e.g., distinct sets that are each coated with a reagent for a particular bioassay, allowing the capture and detection of specific analytes from a sample in a multiplex manner. The Luminex® assay technology can be compared to a multiplex ELISA assay using bead-based fluorescence cytometry to detect analytes such as biomarkers.

The disclosure also encompasses kits for detecting the presence of a polypeptide or nucleic acid corresponding to a marker described herein in a biological sample, e.g., a sample containing tissue, whole blood, serum, plasma, buccal scrape, saliva, cerebrospinal fluid, urine, stool, and bone marrow. Such kits can be used to determine a subject's risk for developing severe CRS. For example, the kit can comprise a labeled compound or agent capable of detecting a polypeptide or an mRNA encoding a polypeptide corresponding to a marker described herein in a biological sample and means for determining the amount of the polypeptide or mRNA in the sample (e.g., an antibody which binds the polypeptide or an oligonucleotide probe which binds to DNA or mRNA encoding the polypeptide). Kits can also include instructions for interpreting the results obtained using the kit.

The disclosure thus includes a kit for assessing a subject's risk for developing severe CRS.

Suitable reagents for binding with a polypeptide corresponding to a marker described herein include antibodies, antibody derivatives, antibody fragments, and the like. Suitable reagents for binding with a nucleic acid (e.g., a genomic DNA, an mRNA, a spliced mRNA, a cDNA, or the like) include complementary nucleic acids. For example, the nucleic acid reagents can include oligonucleotides (labeled or non-labeled) fixed to a substrate, labeled oligonucleotides not bound with a substrate, pairs of PCR primers, molecular beacon probes, and the like.

The kit can optionally comprise additional components useful for performing the methods described herein. By way of example, the kit can comprise fluids (e.g., SSC buffer) suitable for annealing complementary nucleic acids or for binding an antibody with a protein with which it specifically binds, one or more sample compartments, an instructional material which describes performance of a method of the invention, a reference sample for comparison of expression levels of the biomarkers described herein, and the like.

A kit of the invention can comprise a reagent useful for determining protein level or protein activity of a marker. Therapeutic Agents, Compositions and Administration The methods described herein can be used to assess risk status for developing severe CRS in a subject, e.g., where the subject will be administered or has been administered a cell expressing a CAR.

In one embodiment, the cell expresses a CAR molecule comprising an antigen binding domain (e.g., an antibody or antibody fragment that specifically binds to a tumor antigen), a transmembrane domain, and an intracellular signaling domain (e.g., an intracellular signaling domain comprising a costimulatory domain and/or a primary signaling domain). In an embodiment, the antigen binding domain comprises any antibody, or a fragment thereof, e.g., an scFv, known in the art that targets or specifically binds to any of the tumor antigens described herein. For example, the tumor antigen is CD19. The antibody, or fragment thereof, can be a murine, humanized, or fully human antibody or fragment thereof, e.g., an scFv.

In one embodiment, the CAR comprises an antibody or antibody fragment which includes an anti-CD19 binding domain described herein (e.g., a murine or humanized antibody or antibody fragment that specifically binds to CD19 as described herein), a transmembrane domain described herein, and an intracellular signaling domain described herein (e.g., an intracellular signaling domain comprising a costimulatory domain and/or a primary signaling domain described herein).

Antigen Binding Domain

In one aspect, the CAR comprises a target-specific binding element otherwise referred to as an antigen binding domain. The choice of moiety depends upon the type and number of ligands that define the surface of a target cell. For example, the antigen binding domain may be chosen to recognize a ligand that acts as a cell surface marker on target cells associated with a particular disease state. Thus, examples of cell surface markers that may act as ligands for the antigen binding domain in a CAR of the invention include those associated with viral, bacterial and parasitic infections, autoimmune disease and cancer cells.

In one aspect, the CAR-mediated T-cell response can be directed to an antigen of interest by way of engineering an antigen binding domain that specifically binds a desired antigen into the CAR.

In one aspect, the portion of the CAR comprising the antigen binding domain comprises an antigen binding domain that targets a tumor antigen, e.g., a tumor antigen described herein.

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, a T cell receptor (TCR), or a fragment there of, e.g., single chain TCR, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

Murine CD19 CAR constructs are described in PCT publication WO 2012/079000, incorporated herein by reference, and the amino acid sequence of the murine CD19 CAR and scFv constructs are shown in Table 1 below.

TABLE 1

Murine CD19 CAR Constructs

| | SEQ ID NO: | Sequence |
|---|---|---|
| CTL019 Full - aa | 54 | MALPVTALLLPLALLLHAARPdiqmtqttsslsaslgdrvtiscrasqdiskylnw yqqkpdgtvklliyhtsrlhsgvpsrfsgsgsgtdysltisnleqediatyfcqqg ntlpytfgggtkleitggggsggggsggggsevklqesgpglvapsqslsvtctvs gvslpdygvswirqpprkglewlgviwgsettyynsalksrltiikdnsksqvflk mnslqtddtaiyycakhyyyggsyamdywgqgtsvtvsstttpaprpptpaptias qplslrpeacrpaaggavhtrgldfacdiyiwaplagtcgvlllslvitlyckrgr kkllyifkqpfmrpvqttqeedgcscrfpeeeeggcelrvkfsrsadapaykqgqn qlynelnlgrreeydvldkrrgrdpemggkprrknpqeglynelqkdkmaeaysei gmkgerrrgkghdglyqglstatkdtydalhmqalppr |
| CTL019 scFv domain | 85 | Diqmtqttsslsaslgdrvtiscrasqdiskylnwyqqkpdgtvklliyhtsrlhs gvpsrfsgsgsgtdysltisnleqediatyfcqqgntlpytfgggtkleitggggs ggggsggggsevklqesgpglvapsqslsvtctvsgvslpdygvswirqpprkgle wlgviwgsettyynsalksrltiikdnsksqvflkmnslqtddtaiyycakhyyyg gsyamdywgqgtsvtvss |
| mCAR1 scFv | 86 | QVQLLESGAELVRPGSSVKISCKASGYAFSSYWMNWVKQRPGQGLEWIGQIYPGDG DTNYNGKFKGQATLTADKSSSTAYMQLSGLTSEDSAVYSCARKTISSVVDFYFDYW GQGTTVTGGGSGGGSGGGSGGGSELVLTQSPKFMSTSVGDRVSVTCKASQNVGTNV AWYQQKPGQSPKPLIYSATYRNSGVPDRFTGSGSGTDFTLTITNVQSKDLADYFCQ YNRYPYTSFFFTKLEIKRRS |

TABLE 1-continued

| Murine CD19 CAR Constructs | | |
|---|---|---|
| | SEQ ID NO: | Sequence |
| mCAR1 Full - aa | 87 | QVQLLESGAELVRPGSSVKISCKASGYAFSSYWMNWVKQRPGQGLEWIGQIYPGDG<br>DTNYNGKFKGQATLTADKSSSTAYMQLSGLTSEDSAVYSCARKTISSVVDFYFDYW<br>GQGTTVTGGGSGGGSGGGSGGGSELVLTQSPKFMSTSVGDRVSVTCKASQNVGTNV<br>AWYQQKPGQSPKPLIYSATYRNSGVPDRFTGSGSGTDFTLTITNVQSKDLADYFCQ<br>YNRYPYTSFFFTKLEIKRRSKIEVMYPPPYLDNEKSNGTIIHVKGKHLCPSPLFPG<br>PSKPFWVLVVVGGVLACYSLLVTVAFIIFWVRSKRSRLLHSDYMNMTPRRPGPTRK<br>HYQPYAPPRDFAAYRSRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTA<br>TKDTYDALHMQALPPR |
| mCAR2 scFv | 88 | DIQMTQTTSSLSASLGDRVTISCRASQDISKYLNWYQQKPDGTVKLLIYHTSRLHS<br>GVPSRFSGSGSGTDYSLTISNLEQEDIATYFCQQGNTLPYTFGGGTKLEITGSTSG<br>SGKPGSGEGSTKGEVKLQESGPGLVAPSQSLSVTCTVSGVSLPDYGVSWIRQPPRK<br>GLEWLGVIWGSETTYYNSALKSRLTIIKDNSKSQVFLKMNSLQTDDTAIYYCAKHY<br>YYGGSYAMDYWGQGTSVTVSSE |
| mCAR2 CAR - aa | 89 | DIQMTQTTSSLSASLGDRVTISCRASQDISKYLNWYQQKPDGTVKLLIYHTSRLHS<br>GVPSRFSGSGSGTDYSLTISNLEQEDIATYFCQQGNTLPYTFGGGTKLEITGSTSG<br>SGKPGSGEGSTKGEVKLQESGPGLVAPSQSLSVTCTVSGVSLPDYGVSWIRQPPRK<br>GLEWLGVIWGSETTYYNSALKSRLTIIKDNSKSQVFLKMNSLQTDDTAIY<br>YCAKHYYYGGSYAMDYWGQGTSVTVSSESKYGPPCPPCPMFWVLVVVGGVLACYSL<br>LVTVAFIIFWVKRGRKKLLYIFKQPFMRPVQTTQEEDGCSCRFEEEEGGCELRVKF<br>SRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPRL |
| mCAR2 Full - aa | 90 | DIQMTQTT SSLSASLGDR VTISCRASQD ISKYLNWYQQ KPDGTVKLLI<br>YHTSRLHSGV PSRFSGSGSG TDYSLTISNL EQEDIATYFC QQGNTLPYTF<br>GGGTKLEITG STSGSGKPGS GEGSTKGEVK LQESGPGLVA PSQSLSVTCT<br>VSGVSLPDYG VSWIRQPPRK GLEWLGVIWG SETTYYNSAL KSRLTIIKDN<br>SKSQVFLKMN SLQTDDTAIY YCAKHYYYGG SYAMDYWGQG TSVTVSSESK<br>YGPPCPPCPM FWVLVVVGGV LACYSLLVTV<br>AFIIFWVKRG RKKLLYIFKQ PFMRPVQTTQ EEDGCSCRFE EEEGGCELRV<br>KFSRSADAPA YQQGQNQLYN ELNLGRREEY DVLDKRRGRD PEMGGKPRRK<br>NPQEGLYNEL QKDKMAEAYS EIGMKGERRR GKGHDGLYQG LSTATKDTYD<br>ALHMQALPPR LEGGGEGRGS LLTCGDVEEN PGPRMLLLVT SLLLCELPHP<br>AFLLIPRKVC NGIGIGEFKD SLSINATNIK HFKNCTSISG DLHILPVAFR<br>GDSFTHTPPL DPQELDILKT VKEITGFLLI QAWPENRTDL HAFENLEIIR<br>GRTKQHGQFS LAVVSLNITS LGLRSLKEIS DGDVIISGNK NLCYANTINW<br>KKLFGTSGQK TKIISNRGEN SCKATGQVCH ALCSPEGCWG PEPRDCVSCR<br>NVSRGRECVD KCNLLEGEPR EFVENSECIQ CHPECLPQAM NITCTGRGPD<br>NCIQCAHYID GPHCVKTCPA GVMGENNTLV WKYADAGHVC HLCHPNCTYG<br>CTGPGLEGCP TNGPKIPSIA TGMVGALLLL LVVALGIGLF M |
| mCAR3 scFv | 91 | DIQMTQTTSSLSASLGDRVTISCRASQDISKYLNWYQQKPDGTVKLLIYHTSRLHS<br>GVPSRFSGSGSGTDYSLTISNLEQEDIATYFCQQGNTLPYTFGGGTKLEITGSTSG<br>SGKPGSGEGSTKGEVKLQESGPGLVAPSQSLSVTCTVSGVSLPDYGVSWIRQPPRK<br>GLEWLGVIWGSETTYYNSALKSRLTIIKDNSKSQVFLKMNSLQTDDTAIYYCAKHY<br>YYGGSYAMDYWGQGTSVTVSS |
| mCAR3 Full - aa | 92 | DIQMTQTTSSLSASLGDRVTISCRASQDISKYLNWYQQKPDGTVKLLIYHTSRLHS<br>GVPSRFSGSGSGTDYSLTISNLEQEDIATYFCQQGNTLPYTFGGGTKLEITGSTSG<br>SGKPGSGEGSTKGEVKLQESGPGLVAPSQSLSVTCTVSGVSLPDYGVSWIRQPPRK<br>GLEWLGVIWGSETTYYNSALKSRLTIIKDNSKSQVFLKMNSLQTDDTAIYYCAKHY<br>YYGGSYAMDYWGQGTSVTVSSAAAIEVMYPPPYLDNEKSNGTIIHVKGKHLCPSPL<br>FPGPSKPFWVLVVVGGVLACYSLLVTVAFIIFWVRSKRSRLLHSDYMNMTPRRPGP<br>TRKHYQPYAPPRDFAAYRSRVKFSRSADAPAYQQGQNQLYNELNLGRREEYDVLDK<br>RRGRDPEMGGKPRRKNPQEGLYNELQKDKMAEAYSEIGMKGERRRGKGHDGLYQGL<br>STATKDTYDALHMQALPPR |

CD19 CAR constructs containing humanized anti-CD19 scFv domains are described in PCT publication WO 2014/153270, incorporated herein by reference.

In an embodiment, the antigen binding domain comprises an anti-CD19 antibody, or fragment thereof, e.g., an scFv. For example, the antigen binding domain comprises a variable heavy chain and a variable light chain listed in Table 2. The linker sequence joining the variable heavy and variable light chains can be, e.g., any of the linker sequences described herein, or alternatively, can be GST-SGSGKPGSGEGSTKG (SEQ ID NO:45).

TABLE 2

Anti-CD19 antibody binding domains

| | |
|---|---|
| CD19 huscFv1 | EIVMTQSPATLSLSPGERATLSCRASQDISKYLNWYQQKPGQAPRLLIYHTSRL HSGIPARFSGSGSGTDYTLTISSLQPEDFAVYFCQQGNTLPYTFGQGTKLEIK<u>G GGGSGGGGSGGGGS</u>QVQLQESGPGLVKPSETLSLTCTVSGVSLPDYGVSWIRQP PGKGLEWIGVIWGSETTYYSSSLKSRVTISKDNSKNQVSLKLSSVTAADTAVYY CAKHYYYGGSYAMDYWGQGTLVTVSS (SEQ ID NO: 24) |
| CD19 huscFv2 | Eivmtqspatlslspgeratlscrasqdiskylnwyqqkpgqaprlliyhtsrlhsgip arfsgsgsgtdytltisslqpedfavyfcqqgntlpytfgqgtkleik<u>ggggsggggsg ggg</u>sqvqlqesgpglvkpsetlsltctvsgvslpdygvswirqppgkglewigviwgse ttyyqsslksrvtiskdnsknqvslklssvtaadtavyycakhyyyggsyamdywgqgt lvtvss (SEQ ID NO: 25) |
| CD19 huscFv3 | Qvqlqesgpglvkpsetlsltctvsgvslpdygvswirqppgkglewigviwgsettyy ssslksrvtiskdnsknqvslklssvtaadtavyycakhyyyggsyamdywgqgtlvtv ss<u>ggggsggggsggggs</u>eivmtqspatlslspgeratlscrasqdiskylnwyqqkpgq aprlliyhtsrlhsgiparfsgsgsgtdytltisslqpedfavyfcqqgntlpytfgqg tkleik (SEQ ID NO: 26) |
| CD19 huscFv4 | Qvqlqesgpglvkpsetlsltctvsgvslpdygvswirqppgkglewigviwgsettyy qsslksrvtiskdnsknqvslklssvtaadtavyycakhyyyggsyamdywgqgtlvtv ss<u>ggggsggggsggggs</u>eivmtqspatlslspgeratlscrasqdiskylnwyqqkpgq aprlliyhtsrlhsgiparfsgsgsgtdytltisslqpedfavyfcqqgntlpytfgqg tkleik (SEQ ID NO: 27) |
| CD19 huscFv5 | Eivmtqspatlslspgeratlscrasqdiskylnwyqqkpgqaprlliyhtsrlhsgip arfsgsgsgtdytltisslqpedfavyfcqqgntlpytfgqgtkleik<u>ggggsggggsg gggsgggg</u>sqvqlqesgpglvkpsetlsltctvsgvslpdygvswirqppgkglewigv iwgsettyyssslksrvtiskdnsknqvslklssvtaadtavyycakhyyyggsyamdy wgqgtlvtvss (SEQ ID NO: 39) |
| CD19 huscFv6 | Eivmtqspatlslspgeratlscrasqdiskylnwyqqkpgqaprlliyhtsrlhsgip arfsgsgsgtdytltisslqpedfavyfcqqgntlpytfgqgtkleik<u>ggggsggggsg gggsgggg</u>sqvqlqesgpglvkpsetlsltctvsgvslpdygvswirqppgkglewigv iwgsettyyqsslksrvtiskdnsknqvslklssvtaadtavyycakhyyyggsyamdy wgqgtlvtvss (SEQ ID NO: 43) |
| CD19 huscFv7 | Qvqlqesgpglvkpsetlsltctvsgvslpdygvswirqppgkglewigviwgsettyy ssslksrvtiskdnsknqvslklssvtaadtavyycakhyyyggsyamdywgqgtlvtv ss<u>ggggsggggsggggsggggsgggg</u>seivmtqspatlslspgeratlscrasqdiskylnwyq qkpgqaprlliyhtsrlhsgiparfsgsgsgtdytltisslqpedfavyfcqqgntlpy tfgqgtkleik (SEQ ID NO: 46) |
| CD19 huscFv8 | Qvqlqesgpglvkpsetlsltctvsgvslpdygvswirqppgkglewigviwgsettyy qsslksrvtiskdnsknqvslklssvtaadtavyycakhyyyggsyamdywgqgtlvtv ss<u>ggggsggggsggggsggggsgggg</u>seivmtqspatlslspgeratlscrasqdiskylnwyq qkpgqaprlliyhtsrlhsgiparfsgsgsgtdytltisslqpedfavyfcqqgntlpy tfgqgtkleik (SEQ ID NO: 47) |
| CD19 huscFv9 | Eivmtqspatlslspgeratlscrasqdiskylnwyqqkpgqaprlliyhtsrlhsgip arfsgsgsgtdytltisslqpedfavyfcqqgntlpytfgqgtkleik<u>ggggsggggsg gggsgggg</u>sqvqlqesgpglvkpsetlsltctvsgvslpdygvswirqppgkglewigv iwgsettyynsslksrvtiskdnsknqvslklssvtaadtavyycakhyyyggsyamdy wgqgtlvtvss (SEQ ID NO: 48) |
| CD19 HuscFv10 | Qvqlqesgpglvkpsetlsltctvsgvslpdygvswirqppgkglewigviwgsettyy nsslksrvtiskdnsknqvslklssvtaadtavyycakhyyyggsyamdywgqgtlvtv ss<u>ggggsggggsggggsggggsgggg</u>seivmtqspatlslspgeratlscrasqdiskylnwyq qkpgqaprlliyhtsrlhsgiparfsgsgsgtdytltisslqpedfavyfcqqgntlpy tfgqgtkleik (SEQ ID NO: 49) |

TABLE 2-continued

Anti-CD19 antibody binding domains

| | |
|---|---|
| CD19 HuscFv11 | Eivmtqspatlslspgeratlscrasqdiskylnwyqqkpgqaprlliyhtsrlhsgip<br>arfsgsgsgtdytltisslqpedfavyfcqqgntlpytfgqgtkleik<u>ggggsggggsg</u><br><u>gggs</u>qvqlqesgpglvkpsetlsltctvsgvslpdygvswirqppgkglewigviwgse<br>ttyynsslksrvtiskdnsknqvslklssvtaadtavyycakhyyyggsyamdywgqgt<br>lvtvss (SEQ ID NO: 50) |
| CD19 HuscFv12 | Qvqlqesgpglvkpsetlsltctvsgvslpdygvswirqppgkglewigviwgsettyy<br>nsslksrvtiskdnsknqvslklssvtaadtavyycakhyyyggsyamdywgqgtlvtv<br>ss<u>ggggsggggsggggs</u>eivmtqspatlslspgeratlscrasqdiskylnwyqqkpgq<br>aprlliyhtsrlhsgiparfsgsgsgtdytltisslqpedfavyfcqqgntlpytfgqg<br>tkleik (SEQ ID NO: 51) |
| CD19 muCTL019 | Diqmtqttsslsaslgdrvtiscrasqdiskylnwyqqkpdgtvklliyhtsrlhsgvp<br>srfsgsgsgtdysltisnleqediatyfcqqgntlpytfgggtkleit<u>ggggsggggsg</u><br><u>gggs</u>evklqesgpglvapsqslsvtctvsgvslpdygvswirqpprkglewlgviwgse<br>ttyynsalksrltiikdnsksqvflkmnslqtddtaiyycakhyyyggsyamdywgqgt<br>svtvss (SEQ ID NO: 52) |

Any known CD19 CAR, e.g., the CD19 antigen binding domain of any known CD19 CAR, in the art can be used in accordance with the present disclosure. For example, the CD19 CAR can be LG-740, or any CAR described in any of the following: U.S. Pat. Nos. 8,399,645; 7,446,190; Xu et al., LEUK LYMPHOMA. 2013 54(2):255-260(2012); Cruz et al., BLOOD 122(17):2965-2973 (2013); Brentjens et al., BLOOD, 118(18):4817-4828 (2011); Kochenderfer et al., BLOOD 116 (20):4099-102 (2010); Kochenderfer et al., BLOOD 122 (25): 4129-39(2013); Kochenderfer, J. N. et al., J. IMMUNOTHER. 32 (7), 689-702 (2009); Genbank accession number HM852952; 16th Annu Meet Am Soc Gen Cell Ther (ASGCT) (May 15-18, Salt Lake City) 2013, Abst 10; WO2012/129514; and WO2014/031687, each of which is herein incorporated by reference.

In one embodiment, the antigen binding domain comprises one, two three (e.g., all three) heavy chain CDRs, HC CDR1, HC CDR2 and HC CDR3, from an antibody listed herein, e.g., above, and/or one, two, three (e.g., all three) light chain CDRs, LC CDR1, LC CDR2 and LC CDR3, from an antibody listed herein, e.g., above. In one embodiment, the antigen binding domain comprises a heavy chain variable region and/or a variable light chain region of an antibody listed or described herein, e.g., above.

In some embodiments, a full CAR construct is a CAR listed in Table 3. Table 3 provides the exemplary full CD19 CAR constructs generated using the various CAR domains (e.g., transmembrane and intracellular signaling domains) listed in Table 2, and the anti-CD19 antigen binding domains listed in Table 2. Amino acid sequences are designated (aa) and nucleic acid sequences are designated (nt).

TABLE 3

CD19 CAR Constructs

| Name | Sequence |
|---|---|
| | CAR 1 |
| 104875<br>CAR 1 -<br>Full - nt | atggccctccctgtcaccgccctgctgcttccgctggctcttctgctccacgccgctcggcccga<br>aattgtgatgacccagtcacccgccactcttagcctttcacccggtgagcgcgcaaccctgtctt<br>gcagagcctcccaagacatctcaaaatacctttaattggtatcaacagaagcccggacaggctcct<br>cgccttctgatctaccacaccagccggctccattctggaatccctgccaggttcagcggtagcgg<br>atctgggaccgactacaccctcactatcagctcactgcagccagaggacttcgctgtctatttct<br>gtcagcaagggaacaccctgccctacacctttggacagggcaccaagctcgagattaaaggtgga<br>ggtggcagcggaggaggtgggtccggcggtggaggaagccaggtccaactccaagaaagcggacc<br>gggtcttgtgaagccatcagaaactctttcactgacttgtactgtgagcggagtgtctctcccg<br>attacggggtgtcttggatcagacagccaccggggaagggtctggaatggattggagtgatttgg<br>ggctctgagactacttactactcttcatccctcaagtcacgcgtcaccatctcaaaggacaactc<br>taagaatcaggtgtcactgaaactgtcatctgtgaccgcagccgacaccgccgtgtactattgcg<br>ctaagcattactattatggcgggagctacgcaatggattactggggacagggtactctggtcacc<br>gtgtccagcaccatcaccccagcaccgaggccaccccacccgctcctaccatcgcctcccagcc<br>tctgtccctgcgtccggaggcatgtagacccgcagctggtgggccgtgcataccgggtcttg<br>acttcgcctgcgatatctacatttgggcccctctggctggtacttgcggggtcctgctgctttca<br>ctcgtgatcactcttactgtaagcgcggtcggaagaagctgctgtacatctttaagcaaccctt<br>catgaggcctgtgcagactactcaagaggaggacggctgttcatgccggttcccagaggaggagg<br>aaggcggctgcgaactgcgcgtgaaattcagccgcagcgcagatgctccagcctacaagcagggg<br>cagaaccagctctacaacgaactcaatcttggtcggagagaggagtacgacgtgctggacaagcg<br>gagaggacgggacccagaaatgggcgggaagccgcgcagaaagaatcccaagagggcctgtaca<br>acgagctccaaaaggataagatggcagaagcctatagcgagattggtatgaaaggggaacgcaga<br>agaggcaaaggccacgacggactgtaccagggactcagcaccgccaccaaggacacctatgacgc<br>tcttcacatgcaggccctgccgcctcgg (SEQ ID NO: 55) |

TABLE 3-continued

CD19 CAR Constructs

| Name | Sequence |
|---|---|
| 104875<br>CAR 1 -<br>Full - aa | MALPVTALLLPLALLLHAARPeivmtqspatlslspgeratlscrasqdiskylnwyqqkpgqap<br>rlliyhtsrlhsgiparfsgsgsgtdytltisslqpedfavyfcqqgntlpytfgqgtkleikgg<br>ggsggggsggggsqvqlqesgpglvkpsetlsltctvsgvslpdygvswirqppgkglewigviw<br>gsettyyssslksrvtiskdnsknqvslklssvtaadtavyycakhyyyggsyamdywgqgtlvt<br>vssttttpaprpptpaptiasqplslrpeacrpaaggavhtrgldfacdiyiwaplagtcgvllls<br>lvitlyckrgrkkllyifkqpfmrpvqttqeedgcscrfpeeeeggcelrvkfsrsadapaykqg<br>qnqlynelnlgrreeydvldkrrgrdpemggkprrknpqeglynelqkdkmaeayseigmkgerr<br>rgkghdglyqglstatkdtydalhmqalppr (SEQ ID NO: 56) |

CAR 2

| | |
|---|---|
| 104876<br>CAR 2 -<br>Full - nt | atggccctccctgtcaccgccctgctgcttccgctggctcttctgctccacgccgctcggcccga<br>aattgtgatgacccagtcacccgccactcttagcctttcacccggtgagcgcgcaaccctgtctt<br>gcagagcctcccaagacatctcaaaataccttaattggtatcaacagaagcccggacaggctcct<br>cgccttctgatctaccacaccagccggctccattctggaatccctgccaggttcagcggtagcgg<br>atctgggaccgactacaccctcactatcagctcactgcagccagagacttcgctgtctatttct<br>gtcagcaagggaacacccctgccctacacctttggacagggcaccaagctcgagattaaaggtgga<br>ggtggcagcggaggaggtgggtccggcggtggaggaagccaggtccaactccaagaaagcggacc<br>gggtcttgtgaagccatcagaaactctttcactgacttgtactgtgagcggagtgtctctcccg<br>attacggggtgtcttggatcagacagccaccggggaagggtctggaatggattggagtgatttgg<br>ggctctgagactacttactaccaatcatccctcaagtcacgcgtcaccatctcaaaggcaactc<br>taagaatcaggtgtcactgaaactgtcatctgtgaccgcagccgacaccgccgtgtactattgcg<br>ctaagcattactattatggcgggagctacgcaatggattactgggacagggtactctggtcacc<br>gtgtccagcaccactaccccagcaccgaggccacccaccccggctcctaccatcgcctcccagcc<br>tctgtccctgcgtccggaggcatgtagacccgcagctggtggggccgtgcatacccggggtcttg<br>acttcgcctgcgatatctacatttgggcccctctggctggtacttgcggggtcctgctgctttca<br>ctcgtgatcactcttttactgtaagcgcggtcggaagaagctgctgtacatctttaagcaacctt<br>catgaggcctgtcagactactcaagaggaggacggctgttcatgccggttcccagaggaggagg<br>aaggcggctgcgaactgcgcgtgaaattcagccgcagcgcagatgctccagcctacaagcagggg<br>cagaaccagctctacaacgaactcaatcttggtcggagagaggagtacgacgtgctggacaagcg<br>gagaggacgggacccagaaatgggcgggaagccgcgcagaaagaatccccaagagggcctgtaca<br>acgagctccaaaaggataagatggcagaagcctatagcgagattggtatgaaaggggaacgcaga<br>agaggcaaaggccacgacggactgtaccagggactcagcaccgccaccaaggacacctatgacgc<br>tcttcacatgcaggccctgccgcctcgg (SEQ ID NO: 57) |
| 104876<br>CAR 2 -<br>Full - aa | MALPVTALLLPLALLLHAARPeivmtqspatlslspgeratlscrasqdiskylnwyqqkpgqap<br>rlliyhtsrlhsgiparfsgsgsgtdytltisslqpedfavyfcqqgntlpytfgqgtkleikgg<br>ggsggggsggggsqvqlqesgpglvkpsetlsltctvsgvslpdygvswirqppgkglewigviw<br>gsettyyqsslksrvtiskdnsknqvslklssvtaadtavyycakhyyyggsyamdywgqgtlvt<br>vssttttpaprpptpaptiasqplslrpeacrpaaggavhtrgldfacdiyiwaplagtcgvllls<br>lvitlyckrgrkkllyifkqpfmrpvqttqeedgcscrfpeeeeggcelrvkfsrsadapaykqg<br>qnqlynelnlgrreeydvldkrrgrdpemggkprrknpqeglynelqkdkmaeayseigmkgerr<br>rgkghdglyqglstatkdtydalhmqalppr (SEQ ID NO: 58) |

CAR 3

| | |
|---|---|
| 104877<br>CAR 3 -<br>Full - nt | atggctctgcccgtgaccgcactcctcctgccactggctctgctgcttcacgccgctcgcccaca<br>agtccagcttcaagaatcagggcctggtctggtgaagccatctgagactctgtccctcacttgca<br>ccgtgagcggagtgtccctcccagactacgagtgagctggattagacagcctcccggaaaggga<br>ctggagtggatcggagtgatttgggggtagcgaaaccacttactattcatcttccctgaagtcacg<br>ggtcaccatttcaaaggataactcaaagaatcaagtgagcctcaagctctcatcagtcaccgccg<br>ctgacaccgccgtgtattactgtgccaagcattactactatggagggtcctacgccatggactac<br>tggggccagggaactctggtcactgtgtcatctggtggaggaggtagcggaggaggcgggagcgg<br>tggaggtggctccgaaatcgtgatgacccagagccctgcaaccctgtcccttctcccggggaac<br>gggctaccctttcttgtcgggcatcacaagatatctcaaaatacctcaattggtatcaacagaag<br>ccggacaggcccctaggcttcttatctaccacacctctcgcctgcatagcgggattcccgcacg<br>ctttagcgggtctggaagcgggaccgactacactctgaccatctcatctctccagcccgaggact<br>tcgccgtctacttctgccagcagggtaacacccctgccgtacaccttcggccagggcaccaagctt<br>gagatcaaaaccactactcccgctccaaggccacccaccccctgccccgaccatcgcctctcagcc<br>gctttccctgcgtccggaggcatgtagacccgcagctggtggggccgtgcatacccggggtcttg<br>acttcgcctgcgatatctacatttgggcccctctggctggtacttgcggggtcctgctgctttca<br>ctcgtgatcactcttttactgtaagcgcggtcggaagaagctgctgtacatctttaagcaacctt<br>catgaggcctgtcagactactcaagaggaggacggctgttcatgccggttcccagaggaggagg<br>aaggcggctgcgaactgcgcgtgaaattcagccgcagcgcagatgctccagcctacaagcagggg<br>cagaaccagctctacaacgaactcaatcttggtcggagagaggagtacgacgtgctggacaagcg<br>gagaggacgggacccagaaatgggcgggaagccgcgcagaaagaatccccaagagggcctgtaca<br>acgagctccaaaaggataagatggcagaagcctatagcgagattggtatgaaaggggaacgcaga<br>agaggcaaaggccacgacggactgtaccagggactcagcaccgccaccaaggacacctatgacgc<br>tcttcacatgcaggccctgccgcctcgg (SEQ ID NO: 59) |

TABLE 3-continued

CD19 CAR Constructs

| Name | Sequence |
|---|---|

104877
CAR 3 -
Full - aa

MALPVTALLLPLALLLHAARPqvqlqesgpglvkpsetlsltctvsgvslpdygvswirqppgkg
lewigviwgsettyyssslksrvtiskdnsknqvslklssvtaadtavyycakhyyyggsyamdy
wgqgtlvtvssggggsggggsggggseivmtqspatlslspgeratlscrasqdiskylnwyqqk
pgqaprlliyhtsrlhsgiparfsgsgsgtdytltisslqpedfavyfcqqgntlpytfgqqtkl
eiktttpaprppptpaptiasqplslrpeacrpaaggavhtrgldfacdiyiwaplagtcgvllls
lvitlyckrgrkkllyifkqpfmrpvqttqeedgcscrfpeeeeggcelrvkfsrsadapaykqg
qnqlynelnlgrreeydvldkrrgrdpemggkprrknpqeglynelqkdkmaeayseigmkgerr
rgkghdglyqglstatkdtydalhmqalppr (SEQ ID NO: 60)

CAR 4

104878
CAR 4 -
Full - nt

```
atggctctgccggtgaccgcactcctcctgccactggctctgctgcttcacgccgctcgcccaca
agtccagcttcaagaatcagggcctggtctggtgaagccatctgagactctgtccctcacttgca
ccgtgagcggagtgtcccctcccagactacggagtgagctggattagacagcctcccggaaaggga
ctggagtggatcggagtgatttgggtagcgaaaccacttactatcaatcttccctgaagtcacg
ggtcaccattttcaaaggataactcaaagaatcaagtgagcctcaagctctcatcagtcaccgccg
ctgacaccgccgtgtattactgtgccaagcattactactatggagggtcctacgccatggactac
tggggccagggaactctggtcactgtgtcatctggtggaggaggtagcggaggaggcgggagcgg
tggaggtggctccgaaatcgtgatgacccagagccctgcaaccctgtccttctcccggggaac
gggctaccctctcttgtcgggcatcacaagatatctcaaaatacctcaattggtatcaacagaag
ccgggacaggccctaggcttcttatctaccacacctctcgcctgcatagcgggattcccgcacg
ctttagcgggtctggaagcgggaccgactacactctgaccatctcatctctccagcccgaggact
tcgccgtctacttctgccagcagggtaacaccctgccgtacaccttcggccagggcaccaagctt
gagatcaaaaccactactcccgctccaaggcaccccacccctgccccgaccatcgcctctcagcc
gctttccctgcgtccggaggcatgtagacccgcagctggtggggccgtgcatacccgggtcttg
acttcgcctgcgatatctacatttgggcccctctggctggtacttgcggggtcctgctgctttca
ctcgtgatcactctttactgtaagcgcggtcggaagaagctgctgtacatctttaagcaacccctt
catgaggcctgtgcagactactcaagaggaggacggctgttcatgccggttcccagaggaggagg
aaggcggctgcgaactgcgcgtgaaattcagccgcagcgacgatgctccagcctacaagcagggg
cagaaccagctctacaacgaactcaatcttggtcggagagaggagtacgacgtgctggacaagcg
gagaggacgggacccagaaatgggcgggaagccgcgcagaaagaatcccaagagggcctgtaca
acgagctccaaaaggataagatggcagaagcctatagcgagattggtatgaaaggggaacgcaga
agaggcaaaggccacgacggactgtaccagggactcagcaccgccaccaa
ggacacctatgacgctcttcacatgcaggccctgccgcctcgg (SEQ ID NO: 61)
```

104878
CAR 4 -
Full-aa

MALPVTALLLPLALLLHAARPqvqlqesgpglvkpsetlsltctvsgvslpdygvswirqppgkg
lewigviwgsettyyssslksrvtiskdnsknqvslklssvtaadtavyycakhyyyggsyamdy
wgqgtlvtvssggggsggggsggggseivmtqspatlslspgeratlscrasqdiskylnwyqqk
pgqaprlliyhtsrlhsgiparfsgsgsgtdytltisslqpedfavyfcqqgntlpytfgqqtkl
eiktttpaprppptpaptiasqplslrpeacrpaaggavhtrgldfacdiyiwaplagtcgvllls
lvitlyckrgrkkllyifkqpfmrpvqttqeedgcscrfpeeeeggcelrvkfsrsadapaykqg
qnqlynelnlgrreeydvldkrrgrdpemggkprrknpqeglynelqkdkmaeayseigmkgerr
rgkghdglyqglstatkdtydalhmqalppr (SEQ ID NO: 62)

CAR 5

CAR5 scFv
domain eivmtqspatlslspgeratlscrasqdiskylnwyqqkpgqaprlliyhtsrlhsgiparfsgs
gsgtdytltisslqpedfavyfcqqgntlpytfgqgtkleikggggsggggsggggsqvq
lqesgpglvkpsetlsltctvsgvslpdygvswirqppgkglewigviwgsettyyssslksrvt
iskdnsknqvslklssvtaadtavyycakhyyyggsyamdywgqgtlvtvss (SEQ ID NO: 63)

104879
CAR 5 -
Full - nt

```
atggccctccctgtcaccgccctgctgcttccgctggctcttctgctccacgccgctcggcccga
aattgtgatgacccagtcacccgccactcttagcctttcacccggtgagcgcgcaaccctgtctt
gcagagcctcccaagacatctcaaaataccttaattggtatcaacagaagccccggacaggctcct
cgcctttctgatctaccacaccagccggctccattctggaatccctgccaggttcagcggtagcgg
atctgggaccgactacaccctcactatcagctcactgcagccagaggacttcgctgtctatttct
gtcagcaagggaacaccctgccctacaccttggacagggcaccaagctcgagattaaaggtgga
ggtggcagcggaggaggtgggtccggcggtggaggaagcggcggaggcgggagccaggtccaact
ccaagaaagcggaccgggtcttgtgaagccatcagaaactctttcactgacttgtactgtgagcg
gagtgtctctccccgattacggggtgtcttggatcagacagccaccggggaagggtctggaatgg
attggagtgatttgggctctgagactacttactactcttcatccctcaagtcacgcgtcaccat
ctcaaaggacaactctaagaatcaggtgtcactgaaactgtcatctgtgaccgcagccgacaccg
ccgtgtactattgcgctaagcattactattatggcgggagctacgcaatggattactggggacag
ggtactctggtcaccgtgtccagcaccactcccagcaccgaggccacccacccggctcctac
catcgcctcccagcctctgtccctgcgtccggaggcatgtagacccgcagctggtggggccgtgc
atacccgggtcttgacttcgcctgcgatatctacatttgggcccctctggctggtacttgcggc
gtcctgctgctttcactcgtgatcactctttactgtaagcgcggtcggaagaagctgctgtacat
ctttaagcaacccttcatgaggcctgtgcagactactcaagaggaggacggctgttcatgccggt
tcccagaggaggagaaggcggctgcgaactgcgcgtgaaattcagccgcagcgacgatgctcca
gcctacaagcagggcagaaccagctctacaacgaactcaatcttggtcggagagaggagtacga
cgtgctggacaagcggagaggacgggacccagaaatgggcgggaagccgcgcagaaagaatcccc
aagagggcctgtacaacgagctccaaaaggataagatggcagaagcctatagcgagattggtatg
aaaggggaacgcagaagaggcaaaggccacgacggactgtaccagggactcagcaccgccaccaa
ggacacctatgacgctcttcacatgcaggccctgccgcctcgg (SEQ ID NO: 64)
```

TABLE 3-continued

CD19 CAR Constructs

| Name | Sequence |
| --- | --- |
| 104879<br>CAR 5 -<br>Full - aa | MALPVTALLLPLALLLHAARPeivmtqspatlslspgeratlscrasqdiskylnwyqqkpgqap<br>rlliyhtsrlhsgiparfsgsgsgtdytltisslqpedfavyfcqqgntlpytfgqgtkleikgg<br>ggsggggsggggsggggsqvqlqesgpglvkpsetlsltctvsgvslpdygvswirqppgkglew<br>igviwgsettyyssslksrvtiskdnsknqvslklssvtaadtavyycakhyyyggsyamdywgq<br>gtlvtvsstttpaprpptpaptiasqplslrpeacrpaaggavhtrgldfacdiyiwaplagtcg<br>vlllslvitlyckrgrkkllyifkqpfmrpvqttqeedgcscrfpeeeeggcelrvkfsrsadap<br>aykqgqnqlynelnlgrreeydvldkrrgrdpemggkprrknpqeglynelqkdkmaeayseigm<br>kgerrrgkghdglyqglstatkdtydalhmqalppr (SEQ ID NO: 65) |

CAR6

| 104880<br>CAR6 -<br>Full - nt | atggccctccctgtcaccgccctgctgcttccgctggctcttctgctccacgccgctcggcccga<br>aattgtgatgacccagtcacccgccactcttagccttttcacccgtgagcgcgcaaccctgtctt<br>gcagagcctcccaagacatctcaaaataccttaattggtatcaacagaagcccggacaggctcct<br>cgccttctgatctaccacaccagccggctccattctggaatccctgccaggttcagcggtagcgg<br>atctgggaccgactacaccctcactatcagctcactgcagccagaggacttcgctgtctatttct<br>gtcagcaaggaacaccctgccctacacctttggacagggcaccaagctcgagattaaaggtgga<br>ggtggcagcggaggaggtgggtccggcggtggaggaagcggaggcggagggagccaggtccaact<br>ccaagaaagcggaccgggtcttgtgaagccatcagaaactctttcactgacttgtactgtgagcg<br>gagtgtctctcccgattacggggtgtcttggatcagacagccaccggggaagggtctggaatgg<br>attggagtgatttggggctctgagactacttactaccaatcatccctcaagtcacgcgtcaccat<br>ctcaaaggacaactctaagaatcaggtgtcactgaaactgtcatctgtgaccgcagccgacaccg<br>ccgtgtactattgcgctaagcattactattggcgggagctacgcaatggattactggggacag<br>ggtactctggtcaccgtgtccagcaccactaccccagcaccgaggccacccaccccggctcctac<br>catcgcctccagcctctgtccctgcgtccggaggcatgtagacccgcagctggtggggccgtgc<br>atacccggggtcttgacttcgcctgcgatatctacatttgggcccctctggctggtacttgcggg<br>gtcctgctgctttcactcgtgatcactcttttactgtaagcgcgtcggaagaagctgctgtacat<br>ctttaagcaacccttcatgaggcctgtgcagactactcaagaggaggacggctgttcatgccgt<br>tcccagaggaggaggaaggcggctgcgaactgcgcgtgaaattcagccgcagcgcagatgctcca<br>gcctacaagcaggggcagaaccagctctacaacgaactcaatcttggtcggagagaggagtacga<br>cgtgctggacaagcggagaggacgggacccagaaatgggcgggaagccgcgcagaaagaatcccc<br>aagagggcctgtacaacgagctccaaaaggataagatggcagaagcctatagcgagattggtatg<br>aaaggggaacgcagaagaggcaaaggccacgacggactgtaccagggactcagcaccgccaccaa<br>ggacacctatgacgctcttcacatgcaggccctgccgcctcgg (SEQ ID NO: 66) |
| --- | --- |

| 104880<br>CAR6 -<br>Full - aa | MALPVTALLLPLALLLHAARPeivmtqspatlslspgeratlscrasqdiskylnwyqqkpgqap<br>rlliyhtsrlhsgiparfsgsgsgtdytltisslqpedfavyfcqqgntlpytfgqgtkleikgg<br>ggsggggsggggsggggsqvqlqesgpglvkpsetlsltctvsgvslpdygvswirqppgkglew<br>igviwgsettyyqsslksrvtiskdnsknqvslklssvtaadtavyycakhyyyggsyamdywgq<br>gtlvtvsstttpaprpptpaptiasqplslrpeacrpaaggavhtrgldfacdiyiwaplagtcg<br>vlllslvitlyckrgrkkllyifkqpfmrpvqttqeedgcscrfpeeeeggcelrvkfsrsadap<br>aykqgqnqlynelnlgrreeydvldkrrgrdpemggkprrknpqeglynelqkdkmaeayseigm<br>kgerrrgkghdglyqglstatkdtydalhmqalppr (SEQ ID NO: 67) |

CAR 7

| 104881<br>CAR 7<br>Full - nt | atggctctgccgtgaccgcactcctcctgccactggctctgctgcttcacgccgctcgcccaca<br>agtccagcttcaagaatcagggcctggtctggtgaagccatctgagactctgtccctcacttgca<br>ccgtgagcggagtgtccctcccagactacggagtgagctggattagacagcctcccggaaaggga<br>ctggagtggatcggagtgatttggggtagcgaaaccacttactattcatcttccctgaagtcacg<br>ggtcaccatttcaaaggataactcaaagaatcaagtgagcctcaagctctcatcagtcaccgccg<br>ctgacaccgccgtgtattactgtgccaagcattactactatggagggtcctacgccatggactac<br>tggggccagggaactctggtcactgtgtcatctggtggaggaggtagcggaggaggcgggagcgg<br>tggaggtggctccggaggtggcggaagcgaaatcgtgatgacccagagccctgcaaccctgtccc<br>tttctcccggggaacgggctacccttttcttgtcgggcatcacaagatatctcaaaataccttaat<br>tggtatcaacagaagccggacaggcccctaggcttcttatctaccacacctctcgcctgtcatag<br>cgggattcccgcacgctttagcgggtctggaagcgggaccgactacactctgaccatctcatctc<br>tccagcccgaggacttcgccgtctacttctgccagcagggtaacaccctgccgtacaccttcggc<br>cagggcaccaagcttgagatcaaaaccactactcccgctccaaggccacccaccccctgccccgac<br>catcgcctctcagccgctttccctgcgtccggaggcatgtagacccgcagctggtggggccgtgc<br>atacccggggtcttgacttcgcctgcgatatctacatttgggcccctctggctggtacttgcggg<br>gtcctgctgctttcactcgtgatcactcttttactgtaagcgcgtcggaagaagctgctgtacat<br>ctttaagcaacccttcatgaggcctgtgcagactactcaagaggaggacggctgttcatgccgt<br>tcccagaggaggaggaaggcggctgcgaactgcgcgtgaaattcagccgcagcgcagatgctcca<br>gcctacaagcaggggcagaaccagctctacaacgaactcaatcttggtcggagagaggagtacga<br>cgtgctggacaagcggagaggacgggacccagaaatgggcgggaagccgcgcagaaagaatcccc<br>aagagggcctgtacaacgagctccaaaaggataagatggcagaagcctatagcgagattggtatg<br>aaaggggaacgcagaagaggcaaaggccacgacggactgtaccagggactcagcaccgccaccaa<br>ggacacctatgacgctcttcacatgcaggccctgccgcctcgg (SEQ ID NO: 68) |
| --- | --- |

TABLE 3-continued

CD19 CAR Constructs

| Name | Sequence |
|---|---|
| 104881<br>CAR 7<br>Full - aa | MALPVTALLLPLALLLHAARPqvqlqesgpglvkpsetlsltctvsgvslpdygvswirqppgkg<br>lewigviwgsettyyssslksrvtiskdnsknqvslklssvtaadtavyycakhyyyggsyamdy<br>wgqgtlvtvssggggsggggsggggsggggseivmtqspatlslspgeratlscrasqdiskyln<br>wyqqkpgqaprlliyhtsrlhsgiparfsgsgsgtdytltisslqpedfavyfcqqgntlpytfg<br>qgtkleiktttpaprpptpaptiasqplslrpeacrpaaggavhtrgldfacdiyiwaplagtcg<br>vlllslvitlyckrgrkkllyifkqpfmrpvqttqeedgcscrfpeeeeggcelrvkfsrsadap<br>aykqgqnqlynelnlgrreeydvldkrrgrdpemggkprrknpqeglynelqkdkmaeayseigm<br>kgerrrgkghdglyqglstatkdtydalhmqalppr (SEQ ID NO: 69) |

CAR 8

| 104882<br>CAR 8 -<br>Full - nt | atggctctgccgtgaccgcactcctcctgccactggctctgctgcttcacgccgctcgcccaca<br>agtccagcttcaagaatcagggcctggtctggtgaagccatctgagactctgtccctcacttgca<br>ccgtgagcggagtgtcccctcccagactacggagtgagctggattagacagcctcccggaaaggga<br>ctggagtggatcggagtgatttggggtagcgaaaccacttactatcaatcttccctgaagtcacg<br>ggtcaccatttcaaaggataactcaaagaatcaagtgagcctcaagctctcatcagtcaccgccg<br>ctgacaccgccgtgtattactgtgccaagcattactactatggagggtcctacgccatggactac<br>tggggccagggaactctggtcactgtgtcatctggtggaggaggtagcggaggaggcgggagcgg<br>tggaggtggctccggaggcggtgggtcagaaatcgtgatgacccagagccctgcaaccctgtccc<br>tttctcccggggaacgggctacccttcttgtcgggcatcacaagatatctcaaaatacctcaat<br>tggtatcaacagaagccggacaggccctaggcttcttatctaccacacctctcgcctgcatag<br>cgggattcccgcacgctttagcgggtctggaagcgggaccgactacactctgaccatctcatctc<br>tccagcccgaggacttcgccgtctacttctgccagcagggtaacaccctgccgtacaccttcggc<br>cagggcaccaagcttgagatcaaaaccactactcccgctcaaggccaccaccccctgccccgac<br>catcgcctctcagccgctttccctgcgtccgggaggcatgtagacccgcagctggtggggccgtgc<br>ataccccggggtcttgacttcgcctgcgatatctacatttgggcccctctggctggtacttgcggg<br>gtcctgctgctttcactcgtgatcactctttactgtaagcgcggtcggaagaagctgctgtacat<br>ctttaagcaaccccttcatgaggcctgtgcagactactcaagaggaggacggctgttcatgccggt<br>tcccagaggaggaggaaggcggctgcgaactgcgcgtgaaattcagccgcagcgcagatgctcca<br>gcctacaagcaggggcagaaccagctctacaacgaactcaatcttggtcggagagaggagtacga<br>cgtgctggacaagcggagaggacgggacccagaaatgggcgggaagccgcgcagaaagaatcccc<br>aagagggcctgtacaacgagctccaaaaggataagatggcagaagcctatagcgagattggtatg<br>aaggggaacgcagaagaggcaaaggccacgacggactgtaccagggactcagcaccgccaccaa<br>ggacacctatgacgctcttcacatgcaggccctgccgcctcgg (SEQ ID NO: 70) |

| 104882<br>CAR 8 -<br>Full - aa | MALPVTALLLPLALLLHAARPqvqlqesgpglvkpsetlsltctvsgvslpdygvswirqppgkg<br>lewigviwgsettyygsslksrvtiskdnsknqvslklssvtaadtavyycakhyyyggsyamdy<br>wgqgtlvtvssggggsggggsggggsggggseivmtqspatlslspgeratlscrasqdiskyln<br>wyqqkpgqaprlliyhtsrlhsgiparfsgsgsgtdytltisslqpedfavyfcqqgntlpytfg<br>qgtkleiktttpaprpptpaptiasqplslrpeacrpaaggavhtrgldfacdiyiwaplagtcg<br>vlllslvitlyckrgrkkllyifkqpfmrpvqttqeedgcscrfpeeeeggcelrvkfsrsadap<br>aykqgqnqlynelnlgrreeydvldkrrgrdpemggkprrknpqeglynelqkdkmaeayseigm<br>kgerrrgkghdglyqglstatkdtydalhmqalppr (SEQ ID NO: 71) |

CAR 9

| 105974<br>CAR 9 -<br>Full - nt | atggccctccctgtcaccgccctgctgcttccgctggctcttctgctccacgccgctcggcccga<br>aattgtgatgacccagtcacccgccactcttagcctttcacccggtgagcgcgcaaccctgtctt<br>gcagagcctcccaagacatctcaaaatacctttaattggtatcaacagaagcccggacaggctcct<br>cgccttctgatctaccacaccagccggctccattctggaatccctgccaggttcagcggtagcgg<br>atctgggaccgactacaccctcactatcagctcactgcagccagaggacttcgctgtctatttct<br>gtcagcaagggaacaccctgccctacacctttggacagggcaccaagctcgagattaaaggtgga<br>ggtggcagcggaggaggtgggtccggcggtggaggaagcggaggcggtgggagccaggtccaact<br>ccaagaaagcggaccgggtcttgtgaagccatcagaaactctttcactgacttgtactgtgagcg<br>gagtgtctctccccgattacggggtgtcttggatcagacagccaccggggaagggtctggaatgg<br>attggagtgatttggggctctgagactacttactacaactcatccctcaagtcacgcgtcaccat<br>ctcaaaggacaactctaagaatcaggtgtcactgaaactgtcatctgtgaccgcagccgacaccg<br>ccgtgtactattgcgctaagcattactattatggcgggagcatacgcaatggattctggggccag<br>ggtactctggtcaccgtgtccagcaccactacccagcaccgaggcacccaccccggctcctac<br>catcgcctccagcctctgtccctgcgtccggaggcatgtagacccgcagctggtggggccgtgc<br>ataccccggggtcttgacttcgcctgcgatatctacatttgggcccctctggctggtacttgcggg<br>gtcctgctgctttcactcgtgatcactctttactgtaagcgcggtcggaagaagctgctgtacat<br>ctttaagcaaccccttcatgaggcctgtgcagactactcaagaggaggacggctgttcatgccggt<br>tcccagaggaggaggaaggcggctgcgaactgcgcgtgaaattcagccgcagcgcagatgctcca<br>gcctacaagcaggggcagaaccagctctacaacgaactcaatcttggtcggagagaggagtacga<br>cgtgctggacaagcggagaggacgggacccagaaatgggcgggaagccgcgcagaaagaatcccc<br>aagagggcctgtacaacgagctccaaaaggataagatggcagaagcctatagcgagattggtatg<br>aaggggaacgcagaagaggcaaaggccacgacggactgtaccagggactcagcaccgccaccaa<br>ggacacctatgacgctcttcacatgcaggccctgccgcctcgg (SEQ ID NO: 72) |

| 105974<br>CAR 9 -<br>Full - aa | MALPVTALLLPLALLLHAARPeivmtqspatlslspgeratlscrasqdiskylnwyqqkpgqap<br>rlliyhtsrlhsgiparfsgsgsgtdytltisslqpedfavyfcqqgntlpytfgqgtkleikgg<br>ggsggggsggggsggggsqvqlqesgpglvkpsetlsltctvsgvslpdygvswirqppgkglew<br>igviwgsettyynsslksrvtiskdnsknqvslklssvtaadtavyycakhyyyggsyamdywgq<br>gtlvtvsstttpaprpptpaptiasqplslrpeacrpaaggavhtrgldfacdiyiwaplagtcg |

TABLE 3-continued

CD19 CAR Constructs

| Name | Sequence |
|---|---|
| | vlllslvitlyckrgrkkllyifkqpfmrpvqttqeedgcscrfpeeeeggcelrvkfsrsadap<br>aykqgqnqlynelnlgrreeydvldkrrgrdpemggkprrknpqeglynelqkdkmaeayseigm<br>kgerrrgkghdglyqglstatkdtydalhmqalppr (SEQ ID NO: 73) |

CAR10

| 105975<br>CAR 10<br>Full - nt | atggccctccctgtcaccgccctgctgcttccgctggctcttctgctccacgccgctcggcccga<br>aattgtgatgacccagtcacccgccactcttagcctttcacccggtgagcgcgcaaccctgtctt<br>gcagagcctcccaagacatctcaaaataccttaattggtatcaacagaagcccggacaggctcct<br>cgccttctgatctaccacaccagccggctccattctggaatccctgccaggttcagcggtagcgg<br>atctgggaccgactacaccctcactatcagctcactgcagccagaggacttcgctgtctatttct<br>gtcagcaagggaacaccctgccctacacctttggacaggcaccaagctcgagattaaaggtgga<br>ggtggcagcggaggaggtgggtccggcggtggaggaagcggaggcggtgggagccaggtccaact<br>ccaagaaagcggaccgggtcttgtgaagccatcagaaactctttcactgacttgtactgtgagcg<br>gagtgtctctcccgattacggggtgtcttggatcagacagccaccggggaagggtctggaatgg<br>attggagtgatttggggctctgagactacttactacaactcatccctcaagtcacgcgtcaccat<br>ctcaaaggacaactctaagaatcaggtgtcactgaaactgtcatctgtgaccgcagccgacaccg<br>ccgtgtactattgcgctaagcattactattatggcgggagctacgcaatggattactggggacag<br>ggtactctggtcaccgtgtccagcaccactacccagcaccgaggccaccacccccggctcctac<br>atcgcctcccagcctctgtccctgcgtccgaggcatgtagacccgcagctggtggggccgtgc<br>atacccggggtcttgacttcgcctgcgatatctacatttgggcccctctggctggtacttgcggg<br>gtcctgctgctttcactcgtgatcactcttttactgtaagcgcggtcggaagaagctgctgtacat<br>ctttaagcaaccctctcatgaggcctgtgcagactactcaagaggaggacggctgttcatgccggt<br>tcccagaggaggaggaaggcggctgcgaactgcgcgtgaaattcagccgcagcgcagatgctcca<br>gcctacaagcaggggcagaaccagctctaaacgaactcaatcttggtcggagagaggagtacga<br>cgtgctggacaagcggagaggacgggacccagaaatgggcgggaagccgcgcagaaagaatcccc<br>aagagggcctgtacaacgagctccaaaaggataagatggcagaagcctatagcgagattggtatg<br>aaaggggaacgcagaagaggcaaaggccacgacggactgtaccagggactcagcaccgccaccaa<br>ggacacctatgacgctcttcacatgcaggccctgccgcctcgg (SEQ ID NO: 74) |

| 105975<br>CAR 10<br>Full - aa | MALPVTALLLPLALLLHAARPEIVMTQSPATLSLSPGERATLSCRASQDISKYLNWYQQKPGQAP<br>RLLIYHTSRLHSGIPARFSGSGSGTDYTLTISSLQPEDFAVYKCQQGNTLPYTFGQGTKLEIKGG<br>GGSGGGGSGGGGSGGGGSQVQLQESGPGLVKPSETLSLTCTVSGVSLPDYGVSWIRQPPGKGLEW<br>IGVIWGSETTYYNSSLKSRVTISKDKSKNQVSLKLSSVTAADTAVYYCAKHYYYGGSYAMDYWGQ<br>GTLVTVSSTTTPAPRPPTPAPTIASQPLSLRPEACRPAAGGAVHTRGLDFACDIYIWAPLAGTCG<br>VLLLSLVITLYCKRGRKKLLYIFKQPFMRPVQTTQEEDGCSCRFPEEEEGGCELRVKFSRSADAP<br>AYKQGQNQLYNELNLGRREEYDVLDKRRGRDPEMGGKPRRKNPQEGLYNELQKDKMAEAYSEIGM<br>KGERRRGKGHDGLYQGLSTATKDTYDALHMQALPPR (SEQ ID NO: 75) |

CAR11

| 105976<br>CAR 11<br>Full - nt | atggctctgcccgtgaccgcactcctcctgccactggctctgctgcttcacgccgctcgcccaca<br>agtccagcttcaagaatcagggcctggtctggtgaagccatctgagactctgtccctcacttgca<br>ccgtgagcggagtgtccctcccagactacggagtgagctggattagacagcctcccggaaaggga<br>ctggagtggatcggagtgatttggggtagcgaaaccacttactataactcttccctgaagtcacg<br>ggtcaccatttcaaaggataactcaaagaatcaagtgagcctcaagctctcatcagtcaccgccg<br>ctgacaccgccgtgtattactgtgccaagcattactactatggagggtcctacgccatggactac<br>tggggccagggaactctggtcactgtgtcatctggtggaggaggtagcggaggaggcgggagcgg<br>tggaggtggctccggaggtggcggaagcgaaatcgtgatgacccagagccctgcaaccctgtccc<br>tttctcccggggaacgggctacccttcttgtcgggcatcacaagatatctcaaaatacctcaat<br>tggtatcaacagaagccgggacaggcccctaggcttcttatctaccacacctctcgcctgcatag<br>cgggattcccgcacgctttagcggtctgaagcgggaccgactacttctgaccatctcatctc<br>tccagcccgaggacttcgccgtctacttctgccagcagggtaacaccctgccgtacaccttcggc<br>cagggcaccaagcttgagatcaaaaccactactcccgctccaaggccaccaccccctgccccgac<br>catcgcctctcagccgtttccctgcgtccgaggcatgtagacccgcagctggtggggccgtgc<br>atacccggggtcttgacttcgcctgcgatatctacatttgggcccctctggctggtacttgcggg<br>gtcctgctgctttcactcgtgatcactcttttactgtaagcgcggtcggaagaagctgctgtacat<br>ctttaagcaaccctctcatgaggcctgtgcagactactcaagaggaggacggctgttcatgccggt<br>tcccagaggaggaggaaggcggctgcgaactgcgcgtgaaattcagccgcagcgcagatgctcca<br>gcctacaagcaggggcagaaccagctctaaacgaactcaatcttggtcggagagaggagtacga<br>cgtgctggacaagcggagaggacgggacccagaaatgggcgggaagccgcgcagaaagaatcccc<br>aagagggcctgtacaacgagctccaaaaggataagatggcagaagcctatagcgagattggtatg<br>aaaggggaacgcagaagaggcaaaggccacgacggactgtaccagggactcagcaccgccaccaa<br>ggacacctatgacgctcttcacatgcaggccctgccgcctcgg (SEQ ID NO: 76) |

| 105976<br>CAR 11<br>Full - aa | MALPVTALLLPLALLLHAARPQVQLQESGPGLVKPSETLSLTCTVSGVSLPDYGVSWIRQPPGKG<br>LEWIGVIWGSETTYYNSSLKSRVTISKDNSKNQVSLKLSSVTAADTAVYYCAKHYYYGGSYAMDY<br>WGQGTLVTVSSGGGGSGGGGSGGGGSGGGGSEIVMTQSPATLSLSPGERATLSCRASQDISKYLN<br>WYQQKPGQAPRLLIYHTSRLHSGIPARFSGSGSGTDYTLTISSLQPEDFAVYCQQGNTLPYTFG<br>QGTKLEIKTTTPAPRPPTPAPTIASQPLSLRPEACRPAAGGAVHTRGLDFACDIYIWAPLAGTCG<br>VLLLSLVITLYCKRGRKKLLYIFKQPFMRPVQTTQEEDGCSCRFPEEEEGGCELRVKFSRSADAP<br>AYKQGQNQLYNELNLGRREEYDVLDKRRGRDPEMGGKPRRKNPQEGLYNELQKDKMAEAYSEIGM<br>KGERRRGKGHDGLYQGLSTATKDTYDALHMQALPPR (SEQ ID NO: 77) |

TABLE 3-continued

| CD19 CAR Constructs | |
|---|---|
| Name | Sequence |

CAR12

| 105977<br>CAR 12 -<br>Full - nt | atggccctcctgtcaccgccctgctgcttccgctggctcttctgctccacgccgctcggcccga<br>aattgtgatgacccagtcacccgccactcttagcctttcacccggtgagcgcgcaaccctgtctt<br>gcagagcctcccaagacatctcaaaataccttaattggtatcaacagaagcccggacaggctcct<br>cgccttctgatctaccacaccagccggctccattctggaatccctgccaggttcagcggtagcgg<br>atctgggaccgactacaccctcactatcagctcactgcagccagaggacttcgctgtctatttct<br>gtcagcaagggaacaccctgccctacacctttggacagggcaccaagctcgagattaaaggtgga<br>ggtggcagcggaggaggtgggtccggcggtggaggaagccaggtccaactccaagaaagcggacc<br>gggtcttgtgaagccatcagaaactctttcactgacttgtactgtgagcggagtgtctctccccg<br>attacggggtgtcttggatcagacagccaccggggaagggtctggaatggattggagtgatttgg<br>ggctctgagactacttactacaactcatccctcaagtcacgcgtcaccatctcaaggacaactc<br>taagaatcaggtgtcactgaaactgtcatctgtgaccgcagccgacaccgccgtgtactattgcg<br>ctaagcattactattatggcggagctacgcaatggattactgggacagggtactctggtcacc<br>gtgtccagcaccactacccgcaccgaggcgcacccacccgcctccaccatcgcctcccagcc<br>tctgtccctgcgtccggaggcatgtagacccgcagctggtggggccgtgcatacccggggtcttg<br>acttcgcctgcgatatctacatttgggcccctctggctggtacttgcggggtcctgctgctttca<br>ctcgtgatcactctttactgtaagcgcggtcggaagaagctgctgtacatctttaagcaacctt<br>catgaggcctgtgcagactactcaagaggaggacggctgttcatgccggttcccagaggaggag<br>aaggcggctgcgaactgcgcgtgaaattcagccgcagcgatgctccagcctacaagcagggg<br>cagaaccagctctacaacgaactcaatcttggtcggagagagtacgacgtgctggacaagcg<br>gagaggacgggacccagaaatgggcgggaagccgcgcagaaagaatcccaagagggcctgtaca<br>acgagctccaaaaggataagatggcagaagcctatagcgagattggtatgaaaggggaacgcaga<br>agaggcaaaggccacgacggactgtaccagggactcagcaccgccaccaaggacacctatgacgc<br>tcttcacatgcaggccctgccgcctcgg (SEQ ID NO: 78) |
| 105977<br>CAR 12 -<br>Full - aa | MALPVTALLLPLALLLHAARPEIVMTQSPATLSLSPGERATLSCRASQDISKYLNWYQQKPGQAP<br>RLLIYHTSRLHSGIPARFSGSGSGTDYTLTISSLQPEDFAVYFCQQGNTLPYTFGQGTKLEIKGG<br>GGSGGGGSGGGGSQVQLQESGPGLVKPSETLSLTCTVSGVSLPDYGVSWIRQPPGKGLEWIGVIW<br>GSETTYYNSSLKSRVTISKDNSKNQVSLKLSSVTAADTAVYYCAKHYYYGGSYAMDYWGQGTLVT<br>VSSTTTPAPRPPTPAPTIASQPLSLRPEACRPAAGGAVHTRGLDFACDIYIWAPLAGTCGVLLLS<br>LVITLYCKRGRKKLLYIFKQPFMRPVQTTQEEDGCSCRFPEEEEGGCELRVKFSRSADAPAYKQG<br>QNQLYNELNLGRREEYDVLDKRRGRDPEMGGKPRRKNPQEGLYNELQKDKMAEAYSEIGMKGERR<br>RGKGHDGLYQGLSTATKDTYDALHMQALPPR (SEQ ID NO: 79) |

CTL019

| CTL019<br>Full - nt | atggccttaccagtgaccgccttgctcctgccgctggccttgctgctccacgccgccaggccgga<br>catccagatgacacagactacatcctccctgtctgcctctctgggagacagagtcaccatcagtt<br>gcagggcaagtcaggacattagtaaatatttaaattggtatcagcagaaaccagatggaactgtt<br>aaactcctgatctaccatacatcaagattacactcaggagtcccatcaaggttcagtggcagtgg<br>gtctgggaacagattattctctcaccattagcaacctggagcaagaagatattgccacttacttt<br>gccaacagggtaatacgcttccgtacacgttcggaggggggaccaagctggagatcacaggtggc<br>ggtggctcgggcggtggtgggtcgggtggcggcggatctgaggtgaaactgcaggagtcaggacc<br>tggcctggtggcgccctcacagagcctgtccgtcacatgcactgtctcagggggtctcattaccccg<br>actatggttaagctggattcgccagcctccacgaaagggtctggagtggctgggagttaatatgg<br>ggtagtgaaaccacatactataattcagctctcaaatccagatgaccatcatcaaggacaactc<br>caagagccaagttttcttaaaaatgaacagtctgcaaactgatgacacagccatttactactgtg<br>ccaaacattattactacggtggtagctatgctatggactactggggccaaggaacctcagtcacc<br>gtctcctcaaccacgacgccagcgccgcgaccaccaacaccggcgcccaccatcgcgtcgcagcc<br>cctgtccctgcgcccagaggcgtgccggccagcggcggggggcgcagtgcacacgagggggctgg<br>acttcgcctgtgatatctacatctgggcgcccttggccgggacttgtggggtccttctcctgtca<br>ctggttatcaccctttactgcaaacggggcagaaagaaactcctgtatattcaaacaaccatt<br>tatgagaccagtacaaactactcaagaggaagatggctgtagctgccgatttccagaagaagaag<br>aaggaggatgtgaactgagagtgaagttcagcaggagcgcagacgccccccgcgtacaagcagggc<br>cagaaccagctctataacgagctcaatctaggacgaagagaggagtacgatgttttggacaagag<br>acgtggccgggaccctgagtggggggaaagccgagaaggaaaaccctcaggaaggcctgtaca<br>atgaactgcagaaagataagatggcggaggcctacagtgagattgggatgaaaggcgagcgccga<br>aggggcaaggggcacgatggcctttaccagggtctcagtacagccaccaaggacacctacgacgc<br>ccttcacatgcaggccctgccccctcgc (SEQ ID NO: 80) |
| CTL019<br>Full - aa | MALPVTALLLPLALLLHAARPdiqmtqttsslsaslgdrvtiscrasqdiskylnwyqqkpdgtv<br>klliyhtsrlhsgvpsrfsgsgsgtdysltisnleqediatyfcqqgntlpytfgggtkleitgg<br>ggsggggsggggsevklqesgpglvapsqslsvtctvsgvslpdygvswirqpprkglewlgviw<br>gsettyynsalksrltiikdnsksqvflkmnslqtddtaiyycakhyyyggsyamdywgqtsvt<br>vssttpaprpptpaptiasqplslrpeacrpaaggavhtrgldfacdiyiwaplagtcgvllls<br>lvitlyckrgrkkllyifkqpfmrpvqttgeedgcscrfpeeeeggcelrvkfsrsadapaykqg<br>qnqlynelnlgrreeydvldkrrgrdpemggkprrknpqeglynelqkdkmaeayseigmkgerr<br>rgkghdglyqglstatkdtydalhmqalppr (SEQ ID NO: 81) |

In an embodiment, the antigen binding domain comprises an anti-CD19 antibody, or fragment thereof, e.g., an scFv. For example, the antigen binding domain comprises a variable heavy chain and a variable light chain listed in Table 4.

The linker sequence joining the variable heavy and variable light chains can be any of the linker sequences described herein, or can be GSTSGSGKPGSGEGSTKG (SEQ ID NO:84).

TABLE 4

Anti-CD19 antibody binding domains

| Antibody | VH Sequence | VL Sequence |
|---|---|---|
| SJ25-C1 | QVQLLESGAELVRPGSSVKISCKASGYAFSSY WMNWVKQRPGQGLEWIGQIYPGDGDTNYNGKF KGQATLTADKSSSTAYMQLSGLTSEDSAVYSC ARKTISSVVDFYFDYWGQGTTVT (SEQ ID NO: 82) | ELVLTQSPKFMSTSVGDRVSVTCKASQNVGTNVA WYQQKPGQSPKPLIYSATYRNSGVPDRFTGSGSG TDFTLTITNVQSKDLADYFYFCQYNRYPYTSGGG TKLEIKRRS (SEQ ID NO: 83) |

TABLE 5

Additional anti-CD19 antibody binding domains

| | | |
|---|---|---|
| mCAR1 scF17 | 338 | QVQLLESGAELVRPGSSVKISCKASGYAFSSYWMNWVKQRPGQGLEWIGQIYPGDG DTNYNGKFKGQATLTADKSSSTAYMQLSGLTSEDSAVYSCARKTISSVVDFYFDYW GQGTTVTGGGSGGGSGGGSGGGSELVLTQSPKFMSTSVGDRVSVTCKASQNVGTNV AWYQQKPGQSPKPLIYSATYRNSGVPDRFTGSGSGTDFTLTITNVQSKDLADYFCQ YNRYPYTSFFFTKLEIKRRS |
| mCAR1 Full- aa | 339 | QVQLLESGAELVRPGSSVKISCKASGYAFSSYWMNWVKQRPGQGLEWIGQIYPGDG DTNYNGKFKGQATLTADKSSSTAYMQLSGLTSEDSAVYSCARKTISSVVDFYFDYW GQGTTVTGGGSGGGSGGGSGGGSELVLTQSPKFMSTSVGDRVSVTCKASQNVGTNV AWYQQKPGQSPKPLIYSATYRNSGVPDRFTGSGSGTDFTLTITNVQSKDLADYFCQ YNRYPYTSFFFTKLEIKRRSKIEVMYPPPYLDNEKSNGTIIHVKGKHLCPSPLFPG PSKPFWVLVVVGGVLACYSLLVTVAFIIFWVRSKRSRLLHSDYMNMTPRRPGPTRK HYQPYAPPRDFAAYRSRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTA TKDTYDALHMQALPPR |
| mCAR2 scFv | 340 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG SGKPGSGEGSTKGEVKLQESGPGLVAPSQSLSVTCTVSGVSLPDYGVSWIRQPPRK GLEWLGVIWGSETTYYNSALKSRLTIIKDNSKSQVFLKMNSLQTDDTAIYYCAKHY YYGGSYAMDYWGQGTSVTVSSE |
| mCAR2 CAR - aa | 341 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG SGKPGSGEGSTKGEVKLQESGPGLVAPSQSLSVTCTVSGVSLPDYGVSWIRQPPRK GLEWLGVIWGSETTYYNSALKSRLTIIKDNSKSQVFLKMNSLQTDDTAIY YCAKHYYYGGSYAMDYWGQGTSVTVSSESKYGPPCPPCPMFWVLVVVGGVLACYSL LVTVAFIIFWVKRGRKKLLYIFKQPFMRPVQTTQEEDGCSCRFEEEEGGCELRVKF SRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPRL |
| mCAR2 Full - aa | 114 | DIQMTQTT SSLSASLGDR VTISCRASQD ISKYLNWYQQ KPDGTVKLLI YHTSRLHSGV PSRFSGSGSG TDYSLTISNL EQEDIATYFC QQGNTLPYTF GGGTKLEITG STSGSGKPGS GEGSTKGEVK LQESGPGLVA PSQSLSVTCT VSGVSLPDYG VSWIRQPPRK GLEWLGVIWG SETTYYNSAL KSRLTIIKDN SKSQVFLKMN SLQTDDTAIY YCAKHYYYGG SYAMDYWGQG TSVTVSSESK YGPPCPPCPM FWVLVVVGGV LACYSLLVTV AFIIFWVKRG RKKLLYIFKQ PFMRPVQTTQ EEDGCSCRFE EEEGGCELRV KFSRSADAPA YQQGQNQLYN ELNLGRREEY DVLDKRRGRD PEMGGKPRRK NPQEGLYNEL QKDKMAEAYS EIGMKGERRR GKGHDGLYQG LSTATKDTYD ALHMQALPPR LEGGGEGRGS LLTCGDVEEN PGPRMLLLVT SLLLCELPHP AFLLIPRKVC NGIGIGEFKD SLSINATNIK HFKNCTSISG DLHILPVAFR GDSFTHTPPL DPQELDILKT VKEITGFLLI QAWPENRTDL HAFENLEIIR GRTKQHGQFS LAVVSLNITS LGLRSLKEIS DGDVIISGNK NLCYANTINW KKLFGTSGQK TKIISNRGEN SCKATGQVCH ALCSPEGCWG PEPRDCVSCR NVSRGRECVD KCNLLEGEPR EFVENSECIQ CHPECLPQAM NITCTGRGPD NCIQCAHYID GPHCVKTCPA GVMGENNTLV WKYADAGHVC HLCHPNCTYG CTGPGLEGCP TNGPKIPSIA TGMVGALLLL LVVALGIGLF M |
| mCAR3 scFv | 115 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG SGKPGSGEGSTKGEVKLQESGPGLVAPSQSLSVTCTVSGVSLPDYGVSWIRQPPRK GLEWLGVIWGSETTYYNSALKSRLTIIKDNSKSQVFLKMNSLQTDDTAIYYCAKHY YYGGSYAMDYWGQGTSVTVSS |
| mCAR3 Full - aa | 116 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG SGKPGSGEGSTKGEVKLQESGPGLVAPSQSLSVTCTVSGVSLPDYGVSWIRQPPRK |

TABLE 5-continued

Additional anti-CD19 antibody binding domains

```
GLEWLGVIWGSETTYYNSALKSRLTIIKDNSKSQVFLKMNSLQTDDTAIYYCAKHY
YYGGSYAMDYWGQGTSVTVSSAAAIEVMYPPPYLDNEKSNGTIIHVKGKHLCPSPL
FPGPSKPFWVLVVVGGVLACYSLLVTVAFIIFWVRSKRSRLLHSDYMNMTPRRPGP
TRKHYQPYAPPRDFAAYRSRVKFSRSADAPAYQQGQNQLYNELNLGRREEYDVLDK
RRGRDPEMGGKPRRKNPQEGLYNELQKDKMAEAYSEIGMKGERRRGKGHDGLYQGL
STATKDTYDALHMQALPPR
```

The sequences of humanized CDR sequences of the scFv domains are shown in Table 6 for the heavy chain variable domains and in Table 7 for the light chain variable domains. "ID" stands for the respective SEQ ID NO for each CDR.

TABLE 6

Heavy Chain Variable Domain CDRs (Kabat)

| Candidate | FW | HCDR 1 | ID | HCDR2 | ID | HCDR3 | ID |
|---|---|---|---|---|---|---|---|
| murine_CART19 | | DYGVS | 117 | VIWGSETTYYNSALKS | 118 | HYYYGGSYAMDY | 122 |
| humanized_CART19 VH4 a | DYGVS | | 117 | VIWGSETTYYSSLKS | 119 | HYYYGGSYAMDY | 122 |
| humanized_CART19 VH4 b | DYGVS | | 117 | VIWGSETTYYQSLKS | 120 | HYYYGGSYAMDY | 122 |
| humanized_CART19 VH4 c | DYGVS | | 117 | VIWGSETTYYNSLKS | 121 | HYYYGGSYAMDY | 122 |

TABLE 7

Light Chain Variable Domain CDRs (Kabat)

| Candidate | FW | LCDR1 | ID | LCDR2 | ID | LCDR3 | ID |
|---|---|---|---|---|---|---|---|
| murine CART 19 | | RASQDISKYLN | 123 | HTSRLHS | 124 | QQGNTLPYT | 125 |
| humanized_CART19 a | VK3 | RASQDISKYLN | 123 | HTSRLHS | 124 | QQGNTLPYT | 125 |
| humanized_CART19 b | VK3 | RASQDISKYLN | 123 | HTSRLHS | 124 | QQGNTLPYT | 125 |
| humanized_CART19 c | VK3 | RASQDISKYLN | 123 | HTSRLHS | 124 | QQGNTLPYT | 125 |

In some embodiments, the CD19 CAR comprises an antigen binding domain derived from (e.g., comprises an amino acid sequence of) an anti-CD19 antibody (e.g., an anti-CD19 mono- or bispecific antibody) or a fragment or conjugate thereof. In one embodiment, the anti-CD19 antibody is a humanized antigen binding domain as described in WO2014/153270 (e.g., Table 3 of WO2014/153270) incorporated herein by reference, or a conjugate thereof. Other exemplary anti-CD19 antibodies or fragments or conjugates thereof, include but are not limited to, a bispecific T cell engager that targets CD19 (e.g., blinatumomab), SAR3419 (Sanofi), MEDI-551 (MedImmune LLC), Combotox, DT2219ARL (Masonic Cancer Center), MOR-208 (also called XmAb-5574; MorphoSys), XmAb-5871 (Xencor), MDX-1342 (Bristol-Myers Squibb), SGN-CD19A (Seattle Genetics), and AFM11 (Affimed Therapeutics). See, e.g., Hammer. MAbs. 4.5(2012): 571-77. Blinatomomab is a bispecific antibody comprised of two scFvs—one that binds to CD19 and one that binds to CD3. Blinatomomab directs T cells to attack cancer cells. See, e.g., Hammer et al.; Clinical Trial Identifier No. NCT00274742 and NCT01209286. MEDI-551 is a humanized anti-CD19 antibody with a Fc engineered to have enhanced antibody-dependent cell-mediated cytotoxicity (ADCC). See, e.g., Hammer et al.; and Clinical Trial Identifier No. NCT01957579. Combotox is a mixture of immunotoxins that bind to CD19 and CD22. The immunotoxins are made up of scFv antibody fragments fused to a deglycosylated ricin A chain. See, e.g., Hammer et al.; and Herrera et al. J. Pediatr. Hematol. Oncol. 31.12(2009):936-41; Schindler et al. Br. J. Haematol. 154.4(2011):471-6. DT2219ARL is a bispecific immunotoxin targeting CD19 and CD22, comprising two scFvs and a truncated diphtheria toxin. See, e.g., Hammer et al.; and Clinical Trial Identifier No. NCT00889408. SGN-CD19A is an antibody-drug conjugate (ADC) comprised of an anti-CD19 humanized monoclonal antibody linked to a synthetic cytotoxic cell-killing agent, monomethyl auristatin F (MMAF). See, e.g., Hammer et al.; and Clinical Trial Identifier Nos. NCT01786096 and NCT01786135. SAR3419 is an anti-CD19 antibody-drug conjugate (ADC) comprising an anti-CD19 humanized monoclonal antibody conjugated to a maytansine derivative via a cleavable linker. See, e.g., Younes et al. J. Clin. Oncol. 30.2(2012): 2776-82; Hammer et al.; Clinical Trial Identifier No. NCT00549185; and Blanc et al. Clin Cancer Res. 2011; 17:6448-58. XmAb-5871 is an Fc-engineered, humanized anti-CD19 antibody. See, e.g., Hammer et al. MDX-1342 is a human Fc-engineered anti-CD19 antibody with enhanced ADCC. See, e.g., Hammer et al. In embodiments, the antibody molecule is a bispecific anti-CD19 and anti-CD3 molecule. For instance, AFM11 is a bispecific antibody that targets CD19 and CD3. See, e.g., Hammer et al.; and Clinical Trial Identifier No. NCT02106091. In some embodiments, an anti-CD19 antibody described herein is conjugated or otherwise bound to a therapeutic agent, e.g., a chemotherapeutic agent, peptide vaccine (such as that described in Izumoto et al. 2008 J Neurosurg 108:963-971), immunosuppressive agent, or immunoablative agent, e.g., cyclosporin, azathioprine, methotrexate, mycophenolate, FK506, CAMPATH, anti-CD3 antibody, cytoxin, fludarabine, rapamycin, mycophenolic acid, steroid, FR901228, or cytokine.

In one embodiment, an antigen binding domain against CD19 is an antigen binding portion, e.g., CDRs, of an antigen binding domain described in a Table herein.

In embodiments the BCMA CAR comprises an anti-BCMA binding domain (e.g., human or humanized anti-BCMA binding domain), a transmembrane domain, and an intracellular signaling domain, and wherein said anti-BCMA binding domain comprises a heavy chain complementary determining region 1 (HC CDR1), a heavy chain complementary determining region 2 (HC CDR2), and a heavy chain complementary determining region 3 (HC CDR3) of any anti-BMCA heavy chain binding domain amino acid sequences listed in Table 8 or 9.

In one embodiment, the anti-BCMA binding domain comprises a light chain variable region described herein (e.g., in Table 8 or 9) and/or a heavy chain variable region described herein (e.g., in Table 8 or 9).

In one embodiment, the encoded anti-BCMA binding domain is a scFv comprising a light chain and a heavy chain of an amino acid sequence of Table 8 or 9.

In an embodiment, the human or humanized anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 8 or 9, or a sequence with at least 95% (e.g., 95-99%) identity thereof; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 8 or 9, or a sequence with at least 95% (e.g., 95-99%) identity thereof.

TABLE 8

Amino Acid and Nucleic Acid Sequences of exemplary anti-BCMA scFv domains and BCMA CAR molecules

| Name/Description | SEQ ID NO: | Sequence |
|---|---|---|
| 139109 | | |
| 139109- aa ScFv domain | 93 | EVQLVESGGGLVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSSASGGGGSGGRASGGGGSDIQLTQSPSSLS ASVGDRVTITCRASQSISSYLNWYQQKPGKAPKLLIYAASSLQSGVPS RFSGSGSGTDFTLTISSLQPEDFATYYCQQSYSTPYTFGQGTKVEIK |
| 139109- nt ScFv domain | 94 | GAAGTGCAATTGGTGGAATCAGGGGGAGGACTTGTGCAGCCTGGAGGA TCGCTGAGACTGTCATGTGCCGTGTCCGGCTTTGCCCTGTCCAACCAC GGGATGTCCTGGGTCCGCCGCGCGCCTGGAAAGGGCCTCGAATGGGTG TCGGGTATTGTGTACAGCGGTAGCACCTACTATGCCGCATCCGTGAAG GGGAGATTCACCATCAGCCGGGACAACTCCAGGAACACTCTGTACCTC CAAATGAATTCGCTGAGGCCAGAGGACACTGCCATCTACTACTGCTCC GCGCATGGCGGAGAGTCCGACGTCTGGGGACAGGGGACCACCGTGACC GTGTCTAGCGCGTCCGGCGGAGGCGGCAGCGGGGGTCGGGCATCAGGG GGCGGCGGATCGGACATCCAGCTCACCCAGTCCCCGAGCTCGCTGTCC GCCTCCGTGGGAGATCGGGTCACCATCACGTGCCGCGCCAGCCAGTCG ATTTCCTCCTACCTGAACTGGTACCAACAGAAGCCCGGAAAAGCCCCG AAGCTTCTCATCTACGCCGCCTCGAGCCTGCAGTCAGGAGTGCCCTCA CGGTTCTCCGGCTCCGGTTCCGGTACTGATTTCACCCTGACCATTTCC TCCCTGCAACCGGAGGACTTCGCTACTTACTACTGCCAGCAGTCGTAC TCCACCCCCTACACTTTCGGACAAGGCACCAAGGTCGAAATCAAG |
| 139109- aa VH | 95 | EVQLVESGGGLVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSS |
| 139109- aa VL | 96 | DIQLTQSPSSLSASVGDRVTITCRASQSISSYLNWYQQKPGKAPKLLI YAASSLQSGVPSRFSGSGSGTDFTLTISSLQPEDFATYYCQQSYSTPY TFGQGTKVEIK |
| 139109- aa Full CAR | 97 | MALPVTALLLPLALLLHAARPEVQLVESGGGLVQPGGSLRLSCAVSGF ALSNHGMSWVRRAPGKGLEWVSGIVYSGSTYYAASVKGRFTISRDNSR NTLYLQMNSLRPEDTAIYYCSAHGGESDVWGQGTTVTVSSASGGGGSG GRASGGGGSDIQLTQSPSSLSASVGDRVTITCRASQSISSYLNWYQQK PGKAPKLLIYAASSLQSGVPSRFSGSGSGTDFTLTISSLQPEDFATYY CQQSYSTPYTFGQGTKVEIKTTTPAPRPPTPAPTIASQPLSLRPEACR |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | PAAGGAVHTRGLDFACDIYIWAPLAGTCGVLLLSLVITLYCKRGRKKL LYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNE LQKDKMAEAYSEIGMKGERRRGKGHDGLYQGLSTATKDTYDALHMQAL PPR |
| 139109- nt Full CAR | 98 | ATGGCCCTCCCTGTCACCGCCCTGCTGCTTCCGCTGGCTCTTCTGCTC CACGCCGCTCGGCCCGAAGTGCAATTGGTGGAATCAGGGGGAGGACTT GTGCAGCCTGGAGGATCGCTGAGACTGTCATGTGCCGTGTCCGGCTTT GCCCTGTCCAACCACGGGATGTCCTGGGTCCGCCGCGCGCCTGGAAAG GGCCTCGAATGGGTGTCGGGTATTGTGTACAGCGGTAGCACCTACTAT GCCGCATCCGTGAAGGGGAGATTCACCATCAGCCGGGACAACTCCAGG AACACTCTGTACCTCCAAATGAATTCGCTGAGGCCAGAGGACACTGCC ATCTACTACTGCTCCGCGCATGGCGGAGAGTCCGACGTCTGGGGACAG GGGACCACCGTGACCGTGTCTAGCGCGTCCGGCGGAGGCGGCAGCGGG GGTCGGGCATCAGGGGGCGGCGGATCGGACATCCAGCTCACCCAGTCC CCGAGCTCGCTGTCCGCCTCCGTGGGAGATCGGGTCACCATCACGTGC CGCGCCAGCCAGTCGATTTCCTCCTACCTGAACTGGTACCAACAGAAG CCCGGAAAAGCCCCGAAGCTTCTCATCTACGCCGCCTCGAGCCTGCAG TCAGGAGTGCCCTCACGGTTCTCCGGCTCCGGTTCCGGTACTGATTTC ACCCTGACCATTTCCTCCTGCAACCGGAGGACTTCGCTACTTACTAC TGCCAGCAGTCGTACTCCACCCCCTACACTTTCGGACAAGGCACCAAG GTCGAAATCAAGACCACTACCCCAGCACCGAGGCCACCCACCCCGGCT CCTACCATCGCCTCCCAGCCTCTGTCCCTGCGTCCGAGGCATGTAGA CCCGCAGCTGGTGGGGCCGTGCATACCCGGGGTCTTGACTTCGCCTGC GATATCTACATTTGGGCCCCTCTGGCTGGACTTGCGGGGTCCTGCTG CTTTCACTCGTGATCACTCTTTACTGTAAGCGCGGTCGGAAGAAGCTG CTGTACATCTTTAAGCAACCCTTCATGAGGCCTGTGCAGACTACTCAA GAGGAGGACGGCTGTTCATGCCGGTTCCCAGAGGAGGAGGAAGGCGGC TGCGAACTGCGCGTGAAATTCAGCCGCAGCGCAGATGCTCCAGCCTAC AAGCAGGGGCAGAACCAGCTCTACAACGAACTCAATCTTGGTCGGAGA GAGGAGTACGACGTGCTGGACAAGCGGAGAGGACGGGACCCAGAAATG GGCGGGAAGCCGCGCAGAAAGAATCCCCAAGAGGGCCTGTACAACGAG CTCCAAAAGGATAAGATGGCAGAAGCCTATAGCGAGATTGGTATGAAA GGGGAACGCAGAAGAGGCAAAGGCCACGACGGACTGTACCAGGGACTC AGCACCGCCACCAAGGACACCTATGACGCTCTTCACATGCAGGCCCTG CCGCCTCGG |
| | | 139103 |
| 139103- aa ScFv domain | 99 | QVQLVESGGGLVQPGRSLRLSCAASGFTFSNYAMSWVRQAPGKGLGWV SGISRSGENTYYADSVKGRFTISRDNSKNTLYLQMNSLRDEDTAVYYC ARSPAHYYGGMDVWGQGTTVTVSSASGGGGSGGRASGGGGSDIVLTQS PGTLSLSPGERATLSCRASQSISSSFLAWYQQKPGQAPRLLIYGASRR ATGIPDRFSGSGSGTDFTLTISRLEPEDSAVYYCQQYHSSPSWTFGQG TKLEIK |
| 139103- nt ScFv domain | 100 | CAAGTGCAACTCGTGGAATCTGGTGGAGGACTCGTGCAACCCGGAAGA TCGCTTAGACTGTCGTGTGCCGCCAGCGGGTTCACTTTCTCGAACTAC GCGATGTCCTGGGTCCGCCAGGCACCCGGAAAGGGACTCGGTTGGGTG TCCGGCATTTCCCGGTCCGGCGAAAATACCTACTACGCCGACTCCGTG AAGGGCCGCTTCACCATCTCAAGGGACAACAGCAAAAACACCCTGTAC TTGCAAATGAACTCCCTGCGGGATGAAGATACAGCCGTGTACTATTGC GCCCGGTCGCCTGCCCATTACTACGGCGGAATGGACGTCTGGGGACAG GGAACCACTGTGACTGTCAGCAGCGCGTCGGGTGGCGGCGGCTCAGGG GGTCGGGCCTCCGGGGGGGAGGGTCCGACATCGTGCTGACCCAGTCC CCGGGAACCCTGAGCCTGAGCCCGGGAGAGCGCGCGACCCTGTCATGC CGGGCATCCCAGAGCATTAGCTCCTCCTTTCTCGCCTGGTATCAGCAG AAGCCCGGACAGGCCCCGAGGCTGCTGATCTACGGCGCTAGCAGAAGG GCTACCGGAATCCCAGACCGGTTCTCGGCTCCGGTTCCGGGACCGAT TTCACCCTTACTATCTCGCGCCTGGAACCTGAGGACTTCCGCCGTCTAC TACTGCCAGCAGTACCACTCATCCCCGTCGTGGACGTTCGGACAGGGC ACCAAGCTGGAGATTAAG |
| 139103- aa VH | 101 | QVQLVESGGGLVQPGRSLRLSCAASGFTFSNYAMSWVRQAPGKGLGWV SGISRSGENTYYADSVKGRFTISRDNSKNTLYLQMNSLRDEDTAVYYC ARSPAHYYGGMDVWGQGTTVTVSS |
| 139103- aa VL | 102 | DIVLTQSPGTLSLSPGERATLSCRASQSISSSFLAWYQQKPGQAPRLL IYGASRRATGIPDRFSGSGSGTDFTLTISRLEPEDSAVYYCQQYHSSP SWTFGQGTKLEIK |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| 139103- aa Full CAR | 103 | MALPVTALLLPLALLLHAARPQVQLVESGGGLVQPGRSLRLSCAASGF TFSNYAMSWVRQAPGKGLGWVSGISRSGENTYYADSVKGRFTISRDNS KNTLYLQMNSLRDEDTAVYYCARSPAHYYGGMDVWGQGTTVTVSSASG GGGSGGGRASGGGGSDIVLTQSPGTLSLSPGERATLSCRASQSISSSFL AWYQQKPGQAPRLLIYGASRRATGIPDRFSGSGSGTDFTLTISRLEPE DSAVYYCQQYHSSPSWTFGQGTKLEIKTTTPAPRPPTPAPTIASQPLS LRPEACRPAAGGAVHTRGLDFACDIYIWAPLAGTCGVLLLSLVITLYC KRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNP QEGLYNELQKDKMAEAYSEIGMKGERRRGKGHDGLYQGLSTATKDTYD ALHMQALPPR |
| 139103- nt Full CAR | 104 | ATGGCCCTCCCTGTCACCGCCCTGCTGCTTCCGCTGGCTCTTCTGCTC CACGCCGCTCGGCCCCAAGTGCAACTCGTGGAATCTGGTGGAGGACTC GTGCAACCCGGAAGATCGCTTAGACTGTCGTGTGCCGCCAGCGGGTTC ACTTTCTCGAACTACGCGATGTCCTGGGTCCGCCAGGCACCCGGAAAG GGACTCGGTTGGGTGTCCGGCATTTCCCGGTCCGGCGAAAATACCTAC TACGCCGACTCCGTGAAGGGCCGCTTCACCATCTCAAGGGACAACAGC AAAAACACCCTGTACTTGCAAATGAACTCCCTGCGGGATGAAGATACA GCCGTGTACTATTGCGCCCGGTCGCCTGCCCATTACTACGGCGGAATG GACGTCTGGGGACAGGGAACCACTGTGACTGTCAGCAGCGCGTCGGGT GGCGGCGGCTCAGGGGGTCGGGCCTCCGGGGGGGAGGGTCCGACATC GTGCTGACCCAGTCCCCGGGAACCCTGAGCCTGAGCCCGGGAGAGCGC GCGACCCTGTCATGCCGGGCATCCCAGAGCATTAGCTCCTCCTTTCTC GCCTGGTATCAGCAGAAGCCCGGACAGGCCCCGAGGCTGCTGATCTAC GGCGCTAGCAGAAGGGCTACCGGAATCCCAGACCGGTTCTCCGGCTCC GGTTCCGGGACCGATTTCACCCTTACTATCTCGCGCCTGGAACCTGAG GACTCCGCCGTCTACTACTGCCAGCAGTACCACTCATCCCCGTCGTGG ACGTTCGGACAGGGCACCAAGCTGGAGATTAAGACCACTACCCCAGCA CCGAGGCCACCCACCCCGGCTCCTACCATCGCCTCCCAGCCTCTGTCC CTGCGTCCGGAGGCATGTAGACCCGCAGCTGGTGGGGCCGTGCATACC CGGGGTCTTGACTTCGCCTGCGATATCTACATTTGGGCCCCTCTGGCT GGTACTTGCGGGGTCCTGCTGCTTTCACTCGTGATCACTCTTTACTGT AAGCGCGGTCGGAAGAAGCTGCTGTACATCTTTAAGCAACCCTTCATG AGGCCTGTGCAGACTACTCAAGAGGAGGACGGCTGTTCATGCCGGTTC CCAGAGGAGGAGGAAGGCGGCTGCGAACTGCGCGTGAAATTCAGCCGC AGCGCAGATGCTCCAGCCTACAAGCAGGGGCAGAACCAGCTCTACAAC GAACTCAATCTTGGTCGGAGAGAGGAGTACGACGTGCTGGACAAGCGG AGAGGACGGGACCCAGAAATGGGCGGGAAGCCGCGCAGAAAGAATCCC CAAGAGGGCCTGTACAACGAGCTCCAAAAGGATAAGATGGCAGAAGCC TATAGCGAGATTGGTATGAAAGGGGAACGCAGAAGAGGCAAAGGCCAC GACGGACTGTACCAGGGACTCAGCACCGCCACCAAGGACACCTATGAC GCTCTTCACATGCAGGCCCTGCCGCCTCGG |
| | 139105 | |
| 139105- aa ScFv domain | 105 | QVQLVESGGGLVQPGRSLRLSCAASGFTFDDYAMHWVRQAPGKGLEWV SGISWNSGSIGYADSVKGRFTISRDNAKNSLYLQMNSLRAEDTALYYC SVHSFLAYWGQGTLVTVSSASGGGSGGRASGGGGSDIVMTQTPLSLP VTPGEPASISCRSSQSLLHSNGYNYLDWYLQKPGQSPQLLIYLGSNRA SGVPDRFSGSGSGTDFTLKISRVEAEDVGVYYCMQALQTPYTFGQGTK VEIK |
| 139105- nt ScFv domain | 106 | CAAGTGCAACTCGTCGAATCCGGTGGAGGTCTGGTCCAACCTGGTAGA AGCCTGAGACTGTCGTGTGCGGCCAGCGGATTCACCTTTGATGACTAT GCTATGCACTGGGTGCGGCAGGCCCCAGGAAAGGGCCTGGAATGGGTG TCGGGAATTAGCTGGAACTCCGGGTCCATTGGCTACGCCGACTCCGTG AAGGGCCGCTTCACCATCTCCCGCGACAACGCAAAGAACTCCCTGTAC TTGCAAATGAACTCGCTCAGGGCTGAGGATACCGCGCTGTACTACTGC TCCGTGCATTCCTTCCTGGCCTACTGGGACAGGGAACTCTGGTCACC GTGTCGAGCGCCTCCGGCGGCGGGGGCTCGGTGGACGGGCCTCGGGC GGAGGGGGGTCCGACATCGTGATGACCCAGACCCCGCTGAGCTTGCCC GTGACTCCCGGAGAGCCTGCATCCATCTCCTGCCGGTCATCCCAGTCG CTTCTCCACTCCAACGGATACAACTACCTCGACTGGTACCTCCAGAAG CCGGGACAGAGCCCTCAGCTTCTGATCTACCTGGGGTCAAATAGAGCC TCAGGAGTGCCGGATCGGTTCAGCGGATCTGGTTCGGGAACTGATTTC ACTCTGAAGATTTCCCGCGTGGAAGCCGAGGACGTGGGCGTCTACTAC TGTATGCAGGCGCTGCAGACCCCCTATACCTTCGGCCAAGGGACGAAA GTGGAGATCAAG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| 139105- aa VH | 107 | QVQLVESGGGLVQPGRSLRLSCAASGFTFDDYAMHWVRQAPGKGLEWV SGISWNSGSIGYADSVKGRFTISRDNAKNSLYLQMNSLRAEDTALYYC SVHSFLAYWGQGTLVTVSS |
| 139105- aa VL | 108 | DIVMTQTPLSLPVTPGEPASISCRSSQSLLHSNGYNYLDWYLQKPGQS PQLLIYLGSNRASGVPDRFSGSGSGTDFTLKISRVEAEDVGVYYCMQA LQTPYTFGQGTKVEIK |
| 139105- aa Full CAR | 109 | MALPVTALLLPLALLLHAARPQVQLVESGGGLVQPGRSLRLSCAASGF TFDDYAMHWVRQAPGKGLEWVSGISWNSGSIGYADSVKGRFTISRDNA KNSLYLQMNSLRAEDTALYYCSVHSFLAYWGQGTLVTVSSASGGGGSG GRASGGGGSDIVMTQTPLSLPVTPGEPASISCRSSQSLLHSNGYNYLD WYLQKPGQSPQLLIYLGSNRASGVPDRFSGSGSGTDFTLKISRVEAED VGVYYCMQALQTPYTFGQGTKVEIKTTTPAPRPPTPAPTIASQPLSLR PEACRPAAGGAVHTRGLDFACDIYIWAPLAGTCGVLLLSLVITLYCKR GRKKLLYIFKQPFMRPVQTTQEEDGCSCRFPEEEEGGCELRVKFSRSA DAPAYKQGQNQLYNELNLGRREEYDVLDKRRGRDPEMGGKPRRKNPQE GLYNELQKDKMAEAYSEIGMKGERRRGKGHDGLYQGLSTATKDTYDAL HMQALPPR |
| 139105- nt Full CAR | 110 | ATGGCCCTCCCTGTCACCGCCCTGCTGCTTCCGCTGGCTCTTCTGCTC CACGCCGCTCGGCCCCAAGTGCAACTCGTCGAATCCGGTGGAGGTCTG GTCCAACCTGGTAGAAGCCTGAGACTGTCGTGTGCGGCCAGCGGATTC ACCTTTGATGACTATGCTATGCACTGGGTGCGGCAGGCCCCAGGAAAG GGCCTGGAATGGGTGTCGGGAATTAGCTGGAACTCCGGGTCCATTGGC TACGCCGACTCCGTGAAGGGCCGCTTCACCATCTCCCGCGACAACGCA AAGAACTCCCTGTACTTGCAAATGAACTCGCTCAGGGCTGAGGATACC GCGCTGTACTACTGCTCCGTGCATTCCTTCCTGGCCTACTGGGGACAG GGAACTCTGGTCACCGTGTCGAGCGCCTCCGGCGGCGGGGGCTCGGGT GGACGGGCCTCGGGCGGAGGGGGGTCCGACATCGTGATGACCCAGACC CCGCTGAGCTTGCCCGTGACTCCCGGAGAGCCTGCATCCATCTCCTGC CGGTCATCCCAGTCCCTTCTCCACTCCAACGGATACAACTACCTCGAC TGGTACCTCCAGAAGCCGGGACAGAGCCCTCAGCTTCTGATCTACCTG GGGTCAAATAGAGCCTCAGGAGTGCCGGATCGGTTCAGCGGATCTGGT TCGGGAACTGATTTCACTCTGAAGATTTCCCGCGTGGAAGCCGAGGAC GTGGGCGTCTACTACTGTATGCAGGCGCTGCAGACCCCCTATACCTTC GGCCAAGGGACGAAAGTGGAGATCAAGACCACTACCCCAGCACCGAGG CCACCCACCCCGGCTCCTACCATCGCCTCCCAGCCTCTGTCCCTGCGT CCGGAGGCATGTAGACCCGCAGCTGGTGGGGCCGTGCATACCCGGGGT CTTGACTTCGCCTGCGATATCTACATTTGGGCCCCTCTGGCTGGTACT TGCGGGGTCCTGCTGCTTTCACTCGTGATCACTCTTTACTGTAAGCGC GGTCGGAAGAAGCTGCTGTACATCTTTAAGCAACCCTTCATGAGGCCT GTGCAGACTACTCAAGAGGAGGACGGCTGTTCATGCCGGTTCCCAGAG GAGGAGGAAGGCGGCTGCGAACTGCGCGTGAAATTCAGCCGCAGCGCA GATGCTCCAGCCTACAAGCAGGGGCAGAACCAGCTCTACAACGAACTC AATCTTGGTCGGAGAGAGGAGTACGACGTGCTGGACAAGCGGAGAGGA CGGGACCCAGAAATGGGCGGGAAGCCGCGCAGAAAGAATCCCCAAGAG GGCCTGTACAACGAGCTCCAAAAGGATAAGATGGCAGAAGCCTATAGC GAGATTGGTATGAAAGGGGAACGCAGAAGAGGCAAAGGCCACGACGGA CTGTACCAGGGACTCAGCACCGCCACCAAGGACACCTATGACGCTCTT CACATGCAGGCCCTGCCGCCTCGG |

139111

| 139111- aa ScFv domain | 111 | EVQLLESGGGLVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSSASGGGGSGGRASGGGGSDIVMTQTPLSLS VTPGQPASISCKSSQSLLRNDGKTPLYWYLQKAGQPPQLLIYEVSNRF SGVPDRFSGSGSGTDFTLKISRVEAEDVGAYYCMQNIQFPSFGGGTKL EIK |
| 139111- nt ScFv domain | 112 | GAAGTGCAATTGTTGGAATCTGGAGGAGGACTTGTGCAGCCTGGAGGA TCACTGAGACTTTCGTGTGCGGTGTCAGGCTTCGCCCTGAGCAACCAC GGCATGAGCTGGGTGCGGAGAGCCCCGGGGAAGGGTCTGGAATGGGTG TCCGGGATCGTCTACTCCGGTTCAACTTACTACGCCGCAAGCGTGAAG GGTCGCTTCACCATTTCCCGCGATAACTCCCGGAACACCCTGTACCTC CAAATGAACTCCCTGCGGCCCGAGGACACCGCCATCTACTACTGTTCC GCGCATGGAGGAGAGTCCGATGTCTGGGGACAGGGCACTACCGTGACC GTGTCGAGCGCCTCGGGGGAGGAGGCTCCGGCGGTCGCGCCTCCGGG GGGGGTGGCAGCGACATTGTGATGACGCAGACTCCACTCTCGCTGTCC GTGACCCCGGGACAGCCCGCGTCCATCTCGTGCAAGAGCTCCCAGAGC CTGCTGAGGAACGACGGAAAGACTCCTCTGTATTGGTACCTCCAGAAG |

TABLE 8-continued

Amino Acid and Nucleic Acid Sequences of exemplary anti-BCMA scFv domains and BCMA CAR molecules

| Name/Description | SEQ ID NO: | Sequence |
|---|---|---|
| | | GCTGGACAGCCCCGCAACTGCTCATCTACGAAGTGTCAAATCGCTTC<br>TCCGGGGTGCCGGATCGGTTTTCCGGCTCGGGATCGGGCACCGACTTC<br>ACCCTGAAAATCTCCAGGGTCGAGGCCGAGGACGTGGGAGCCTACTAC<br>TGCATGCAAAACATCCAGTTCCCTTCCTTCGGCGGCGGCACAAAGCTG<br>GAGATTAAG |
| 139111- aa VH | 113 | EVQLLESGGGLVQPGGSLRLSCAVSGFALSNHGMSWVRRAPGKGLEWV<br>SGIVYSGSTYYAASVKGRFTISRDNSRNTLYLQMNSLRPEDTAIYYCS<br>AHGGESDVWGQGTTVTVSS |
| 139111- aa VL | 126 | DIVMTQTPLSLSVTPGQPASISCKSSQSLLRNDGKTPLYWYLQKAGQP<br>PQLLIYEVSNRFSGVPDRFSGSGSGTDFTLKISRVEAEDVGAYYCMQN<br>IQFPSFGGGTKLEIK |
| 139111- aa Full CAR | 127 | MALPVTALLLPLALLLHAARPEVQLLESGGGLVQPGGSLRLSCAVSGF<br>ALSNHGMSWVRRAPGKGLEWVSGIVYSGSTYYAASVKGRFTISRDNSR<br>NTLYLQMNSLRPEDTAIYYCSAHGGESDVWGQGTTVTVSSASGGGGSG<br>GRASGGGGSDIVMTQTPLSLSVTPGQPASISCKSSQSLLRNDGKTPLY<br>WYLQKAGQPPQLLIYEVSNRFSGVPDRFSGSGSGTDFTLKISRVEAED<br>VGAYYCMQNIQFPSFGGGTKLEIKTTTPAPRPPTPAPTIASQPLSLRP<br>EACRPAAGGAVHTRGLDFACDIYIWAPLAGTCGVLLLSLVITLYCKRG<br>RKKLLYIFKQPFMRPVQTTQEEDGCSCRFPEEEEGGCELRVKFSRSAD<br>APAYKQGQNQLYNELNLGRREEYDVLDKRRGRDPEMGGKPRRKNPQEG<br>LYNELQKDKMAEAYSEIGMKGERRRGKGHDGLYQGLSTATKDTYDALH<br>MQALPPR |
| 139111- nt Full CAR | 128 | ATGGCCCTCCCTGTCACCGCCCTGCTGCTTCCGCTGGCTCTTCTGCTC<br>CACGCCGCTCGGCCCGAAGTGCAATTGTTGGAATCTGGAGGAGGACTT<br>GTGCAGCCTGGAGGATCACTGAGACTTTCGTGTGCGGTGTCAGGCTTC<br>GCCCTGAGCAACCACGGCATGAGCTGGGTGCGGAGAGCCCCGGGGAAG<br>GGTCTGGAATGGGTGTCCGGGATCGTCTACTCCGGTTCAACTTACTAC<br>GCCGCAAGCGTGAAGGGTCGCTTCACCATTTCCCGCGATAACTCCCGG<br>AACACCCTGTACCTCCAAATGAACTCCCTGCGGCCCGAGGACACCGCC<br>ATCTACTACTGTTCCGCGCATGGAGGAGAGTCCGATGTCTGGGGACAG<br>GGCACTACCGTGACCGTGTCGAGCGCCTCGGGGGGAGGAGGCTCCGGC<br>GGTCGCGCCTCCGGGGGGGTGGCAGCGACATTGTGATGACGCAGACT<br>CCACTCTCGCTGTCCGTGACCCCGGGACAGCCCGCGTCCATCTCGTGC<br>AAGAGCTCCCAGAGCCTGCTGAGGAACGACGGAAAGACTCCTCTGTAT<br>TGGTACCTCCAGAAGGCTGGACAGCCCCCGCAACTGCTCATCTACGAA<br>GTGTCAAATCGCTTCTCCGGGGTGCCGGATCGGTTTTCCGGCTCGGGA<br>TCGGGCACCGACTTCACCCTGAAAATCTCCAGGGTCGAGGCCGAGGAC<br>GTGGGAGCCTACTACTGCATGCAAAACATCCAGTTCCCTTCCTTCGGC<br>GGCGGCACAAAGCTGGAGATTAAGACCACTACCCCAGCACCGAGGCCA<br>CCCACCCCGGCTCCTACCATCGCCTCCCAGCCTCTGTCCCTGCGTCCG<br>GAGGCATGTAGACCCGCAGCTGGTGGGGCCGTGCATACCCGGGGTCTT<br>GACTTCGCCTGCGATATCTACATTTGGGCCCCTCTGGCTGGTACTTGC<br>GGGGTCCTGCTGCTTTCACTCGTGATCACTCTTTACTGTAAGCGCGGT<br>CGGAAGAAGCTGCTGTACATCTTTAAGCAACCCTTCATGAGGCCTGIG<br>CAGACTACTCAAGAGGAGGACGGCTGTTCATGCCGGTTCCCAGAGGAG<br>GAGGAAGGCGGCTGCGAACTGCGCGTGAAATTCAGCCGCAGCGCAGAT<br>GCTCCAGCCTACAAGCAGGGGCAGAACCAGCTCTACAACGAACTCAAT<br>CTTGGTCGGAGAGAGGAGTACGACGTGCTGGACAAGCGGAGAGGACGG<br>GACCCAGAAATGGGCGGGAAGCCGCGCAGAAAGAATCCCAAGGAGGGC<br>CTGTACAACGAGCTCCAAAAGGATAAGATGGCAGAAGCCTATAGCGAG<br>ATTGGTATGAAAGGGGAACGCAGAAGAGGCAAAGGCCACGACGGACTG<br>TACCAGGGACTCAGCACCGCCACCAAGGACACCTATGACGCTCTTCAC<br>ATGCAGGCCCTGCCGCCTCGG |
| | | 139100 |
| 139100- aa ScFv domain | 129 | QVQLVQSGAEVRKTGASVKVSCKASGYIFDNFGINWVRQAPGQGLEWM<br>GWINPKNNNTNYAQKFQGRVTITADESTNTAYMEVSSLRSEDTAVYYC<br>ARGPYYYQSYMDVWGQGTMVTVSSASGGGGSGGRASGGGGSDIVMTQT<br>PLSLPVTPGEPASISCRSSQSLLHSNGYNYLNWYLQKPGQSPQLLIYL<br>GSKRASGVPDRFSGSGSGTDFTLHITRVGAEDVGVYYCMQALQTPYTF<br>GQGTKLEIK |
| 139100- nt ScFv domain | 130 | CAAGTCCAACTCGTCCAGTCCGGCGCAGAAGTCAGAAAAACCGGTGCT<br>AGCGTGAAAGTGTCCTGCAAGGCCTCCGGCTACATTTTCGATAACTTC<br>GGAATCAACTGGGTCAGACAGGCCCCGGGCCAGGGGCTGGAATGGATG<br>GGATGGATCAACCCCAAGAACAACAACACCAACTACGCACAGAAGTTC<br>CAGGGCCGCGTGACTATCACCGCCGATGAATGACCAATACCGCCTAC<br>ATGGAGGTGTCCTCCCTGCGGTCGGAGGACACTGCCGTGTATTACTGC |

TABLE 8-continued

Amino Acid and Nucleic Acid Sequences of exemplary anti-BCMA scFv domains and BCMA CAR molecules

| Name/Description | SEQ ID NO: | Sequence |
|---|---|---|
| | | GCGAGGGGCCCATACTACTACCAAAGCTACATGGACGTCTGGGGACAGGGAACCATGGTGACCGTGTCATCCGCCTCCGGTGGTGGAGGCTCCGGGGGGCGGGCTTCAGGAGGCGGAGGAAGCGATATTGTGATGACCCAGACTCCGCTTAGCCTGCCCGTGACTCCTGGAGAACCGGCCTCCATTTCCTGCCGGTCCTCGCAATCACTCCTGCATTCCAACGGTTACAACTACCTGAATTGGTACCTCCAGAAGCCTGGCCAGTCGCCCCAGTTGCTGATCTATCTGGGCTCGAAGCGCGCCTCCGGGGTGCCTGACCGGTTTAGCGGATCTGGGAGCGGCACGGACTTCACTCTCCACATCACCCGCGTGGGAGCGGAGGACGTGGGAGTGTACTACTGTATGCAGGCGCTGCAGACTCCGTACACATTCGGACAGGGCACCAAGCTGGAGATCAAG |
| 139100- aa VH | 131 | QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS |
| 139100- aa VL | 132 | DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK |
| 139100- aa Full CAR | 133 | MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 139100- nt Full CAR | 134 | ATGGCCCTCCCTGTCACCGCCCTGCTGCTTCCGCTGGCTCTTCTGCTCCACGCCGCTCGGCCCCAAGTCCAACTCGTCCAGTCCGGCGCAGAAGTCAGAAAAACCGGTGCTAGCGTGAAAGTGTCCTGCAAGGCCTCCGGCTACATTTTCGATAACTTCGGAATCAACTGGGTCAGACAGGCCCCGGGCCAGGGCTGGAATGGATGGATGGATCAACCCCAAGAACAACAACACCAACTACGCACAGAAGTTCCAGGGCCGCGTGACTATCACCGCCGATGAATCGACCAATACCGCCTACATGGAGGTGTCCTCCCTGCGGTCGGAGGACACTGCCGTGTATTACTGCGCGAGGGGCCCCATACTACTACCAAAGCTACATGGACGTCTGGGGACAGGGAACCATGGTGACCGTGTCATCCGCCTCCGGTGGTGGAGGCTCCGGGGGGCGGGCTTCAGGAGGCGGAGGAAGCGATATTGTGATGACCCAGACTCCGCTTAGCCTGCCCGTGACTCCTGGAGAACCGGCCTCCATTTCCTGCCGGTCCTCGCAATCACTCCTGCATTCCAACGGTTACAACTACCTGAATTGGTACCTCCAGAAGCCTGGCCAGTCGCCCCAGTTGCTGATCTATCTGGGCTCGAAGCGCGCCTCCGGGGTGCCTGACCGGTTTAGCGGATCTGGGAGCGGCACGGACTTCACTCTCCACATCACCCGCGTGGGAGCGGAGGACGTGGGAGTGTACTACTGTATGCAGGCGCTGCAGACTCCGTACACATTCGGACAGGGCACCAAGCTGGAGATCAAGACCACTACCCCAGCACCGAGGCCACCCACCCCGGCTCCTACCATCGCCTCCCAGCCTCTGTCCCTGCGTCCGGAGGCATGTAGACCCGCAGCTGGTGGGGCCGTGCATACCCGGGGTCTTGACTTCGCCTGCGATATCTACATTTGGGCCCCTCTGGCTGGTACTTGCGGGGTCCTGCTGCTTTCACTCGTGATCACTCTTTACTGTAAGCGCGGTCGGAAGAAGCTGCTGTACATCTTTAAGCAACCCTTCATGAGGCCTGTGCAGACTACTCAAGAGGAGGACGGCTGTTCATGCCGGTTCCCAGAGGAGGAGGAAGGCGGCTGCGAACTGCGCGTGAAATTCAGCCGCAGCGCAGATGCTCCAGCCTACAAGCAGGGGCAGAACCAGCTCTACAACGAACTCAATCTTGGTCGGAGAGAGGAGTACGACGTGCTGGACAAGCGGAGAGGACGGGACCCAGAAATGGGCGGGAAGCCGCGCAGAAAGAATCCCCAAGAGGGCCTGTACAACGAGCTCCAAAAGGATAAGATGGCAGAAGCCTATAGCGAGATTGGTATGAAAGGGGAACGCAGAAGAGGCAAAGGCCACGACGGACTGTACCAGGGACTCAGCACCGCCACCAAGGACACCTATGACGCTCTTCACATGCAGGCCCTGCCGCCTCGG |

139101

| 139101- aa ScFv domain | 135 | QVQLQESGGGLVQPGGSLRLSCAASGFTSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK |

TABLE 8-continued

Amino Acid and Nucleic Acid Sequences of exemplary anti-BCMA scFv domains and BCMA CAR molecules

| Name/ Description | SEQ ID NO: | Sequence |
| --- | --- | --- |
| 139101- nt ScFv domain | 136 | CAAGTGCAACTTCAAGAATCAGGCGGAGGACTCGTGCAGCCCGGAGGA TCATTGCGGCTCTCGTGCGCCGCCTCGGGCTTCACCTTCTCGAGCGAC GCCATGACCTGGGTCCGCCAGGCCCCGGGGAAGGGGCTGGAATGGGTG TCTGTGATTTCCGGCTCCGGGGGAACTACGTACTACGCCGATTCCGTG AAAGGTCGCTTCACTATCTCCCGGGACAACAGCAAGAACACCCTTTAT CTGCAAATGAATTCCCTCCGCGCCGAGGACACCGCCGTGTACTACTGC GCCAAGCTGGACTCCTCGGGCTACTACTATGCCCGGGGTCCGAGATAC TGGGGACAGGGAACCCTCGTGACCGTGTCCTCCGCGTCCGGCGGAGGA GGGTCGGGAGGGCGGGCCTCCGGCGGCGGCGGTTCGGACATCCAGCTG ACCCAGTCCCCATCCTCACTGAGCGCAAGCGTGGGCGACAGAGTCACC ATTACATGCAGGGCGTCCCAGAGCATCAGCTCCTACCTGAACTGGTAC CAACAGAAGCCTGGAAAGGCTCCTAAGCTGTTGATCTACGGGGCTTCG ACCCTGGCATCCGGGGTGCCCGCGAGGTTTAGCGGAAGCGGTAGCGGC ACTCACTTCACTCTGACCATTAACAGCCTCCAGTCCGAGGATTCAGCC ACTTACTACTGTCAGCAGTCCTACAAGCGGGCCAGCTTCGGACAGGGC ACTAAGGTCGAGATCAAG |
| 139101- aa VH | 137 | QVQLQESGGGLVQPGGSLRLSCAASGFTFSSDAMTWVRQAPGKGLEWV SVISGSGGTTYYADSVKGRFTISRDNSKNTLYLQMNSLRAEDTAVYYC AKLDSSGYYYARGPRYWGQGTLVTVSS |
| 139101- aa VL | 138 | DIQLTQSPSSLSASVGDRVTITCRASQSISSYLNWYQQKPGKAPKLLI YGASTLASGVPARFSGSGSGTHFTLTINSLQSEDSATYYCQQSYKRAS FGQGTKVEIK |
| 139101- aa Full CAR | 139 | MALPVTALLLPLALLLHAARPQVQLQESGGGLVQPGGSLRLSCAASGF TFSSDAMTWVRQAPGKGLEWVSVISGSGGTTYYADSVKGRFTISRDNS KNTLYLQMNSLRAEDTAVYYCAKLDSSGYYYARGPRYWGQGTLVTVSS ASGGGGSGGRASGGGGSDIQLTQSPSSLSASVGDRVTITCRASQSISS YLNWYQQKPGKAPKLLIYGASTLASGVPARFSGSGSGTHFTLTINSLQ SEDSATYYCQQSYKRASFGQGTKVEIKTTTPAPRPPTPAPTIASQPLS LRPEACRPAAGGAVHTRGLDFACDIYIWAPLAGTCGVLLLSLVITLYC KRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNP QEGLYNELQKDKMAEAYSEIGMKGERRRGKGHDGLYQGLSTATKDTYD ALHMQALPPR |
| 139101- nt Full CAR | 140 | ATGGCCCTCCCTGTCACCGCCCTGCTGCTTCCGCTGGCTCTTCTGCTC CACGCCGCTCGGCCCCAAGTGCAACTTCAAGAATCAGGCGGAGGACTC GTGCAGCCCGGAGGATCATTGCGGCTCTCGTGCGCCGCCTCGGGCTTC ACCTTCTCGAGCGACGCCATGACCTGGGTCCGCCAGGCCCCGGGGAAG GGGCTGGAATGGGTGTCTGTGATTTCCGGCTCCGGGGGAACTACGTAC TACGCCGATTCCGTGAAAGGTCGCTTCACTATCTCCCGGGACAACAGC AAGAACACCCTTTATCTGCAAATGAATTCCCTCCGCGCCGAGGACACC GCCGTGTACTACTGCGCCAAGCTGGACTCCTCGGGCTACTACTATGCC CGGGGTCCGAGATACTGGGGACAGGGAACCCTCGTGACCGTGTCCTCC GCGTCCGGCGGAGGAGGGTCGGGAGGGCGGGCCTCCGGCGGCGGCGGT TCGGACATCCAGCTGACCCAGTCCCCATCCTCACTGAGCGCAAGCGTG GGCGACAGAGTCACCATTACATGCAGGGCGTCCCAGAGCATCAGCTCC TACCTGAACTGGTACCAACAGAAGCCTGGAAAGGCTCCTAAGCTGTTG ATCTACGGGGCTTCGACCCTGGCATCCGGGGTGCCCGCGAGGTTTAGC GGAAGCGGTAGCGGCACTCACTTCACTCTGACCATTAACAGCCTCCAG TCCGAGGATTCAGCCACTTACTACTGTCAGCAGTCCTACAAGCGGGCC AGCTTCGGACAGGGCACTAAGGTCGAGATCAAGACCACTACCCCAGCA CCGAGGCCACCCACCCCGGCTCCTACCATCGCCTCCCAGCCTCTGTCC CTGCGTCCGGAGGCATGTAGACCCGCAGCTGGTGGGGCCGTGCATACC CGGGGTCTTGACTTCGCCTGCGATATCTACATTTGGGCCCCTCTGGCT GGTACTTGCGGGGTCCTGCTGCTTTCACTCGTGATCACTCTTTACTGT AAGCGCGGTCGGAAGAAGCTGCTGTACATCTTTAAGCAACCCTTCATG AGGCCTGTGCAGACTACTCAAGAGGAGGACGGCTGTTCATGCCGGTTC CCAGAGGAGGAGGAAGGCGGCTGCGAACTGCGCGTGAAATTCAGCCGC AGCGCAGATGCTCCAGCCTACAAGCAGGGCAGAACCAGCTCTACAAC GAACTCAATCTTGGTCGGAGAGAGGAGTACGACGTGCTGGACAAGCGG AGAGGACGGGACCCAGAAATGGGCGGGAAGCCGCGCAGAAAGAATCCC CAAGAGGGCCTGTACAACGAGCTCCAAAAGGATAAGATGGCAGAAGCC TATAGCGAGATTGGTATGAAGGGGAACGCAGAAGAGGCAAAGGCCAC GACGGACTGTACCAGGGACTCAGCACCGCCACCAAGGACACCTATGAC GCTCTTCACATGCAGGCCCTGCCGCCTCGG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | 139102 |
| 139102- aa ScFv domain | 141 | QVQLVQSGAEVKKPGASVKVSCKASGYTFSNYGITWVRQAPGQGLEWM GWISAYNGNTNYAQKFQGRVTMTRNTSISTAYMELSSLRSEDTAVYYC ARGPYYYYMDVWGKGTMVTVSSASGGGSGGGRASGGGGSEIVMTQSPL SLPVTPGEPASISCRSSQSLLYSNGYNYVDWYLQKPGQSPQLLIYLGS NRASGVPDRFSGSGSGTDFKLQISRVEAEDVGIYYCMQGRQFPYSFGQ GTKVEIK |
| 139102- nt ScFv domain | 142 | CAAGTCCAACTGGTCCAGAGCGGTGCAGAAGTGAAGAAGCCCGGAGCG AGCGTGAAAGTGTCCTGCAAGGCTTCCGGGTACACCTTCTCCAACTAC GGCATCACTTGGGTGCGCCAGGCCCCGGGACAGGGCCTGGAATGGATG GGGTGGATTTCCGCGTACAACGGCAATACGAACTACGCTCAGAAGTTC CAGGGTAGAGTGACCATGACTAGGAACACCTCCATTTCCACCGCCTAC ATGGAACTGTCCTCCCTGCGGAGCGAGGACACCGCCGTGTACTATTGC GCCCGGGGACCATACTACTACTACATGGATGTCTGGGGGAAGGGGACT ATGGTCACCGTGTCATCCGCCTCGGGAGGCGGCGGATCAGGAGGACGC GCCTCTGGTGGTGGAGGATCGGAGATCGTGATGACCCAGAGCCCTCTC TCCTTGCCCGTGACTCCTGGGGAGCCCGCATCCATTTCATGCCGGAGC TCCCAGTCACTTCTCTACTCCAACGGCTATAACTACGTGGATTGGTAC CTCCAAAAGCCGGGCCAGAGCCCGCAGCTGCTGATCTACCTGGGCTCG AACAGGGCCAGCGGAGTGCCTGACCGGTTCTCCGGGTCGGGAAGCGGG ACCGACTTCAAGCTGCAAATCTCGAGAGTGGAGGCCGAGGACGTGGGA ATCTACTACTGTATGCAGGGCCGCCAGTTTCCGTACTCGTTCGGACAG GGCACCAAAGTGGAAATCAAG |
| 139102- aa VH | 143 | QVQLVQSGAEVKKPGASVKVSCKASGYTFSNYGITWVRQAPGQGLEWM GWISAYNGNTNYAQKFQGRVTMTRNTSISTAYMELSSLRSEDTAVYYC ARGPYYYYMDVWGKGTMVTVSS |
| 139102- aa VL | 144 | EIVMTQSPLSLPVTPGEPASISCRSSQSLLYSNGYNYVDWYLQKPGQS PQLLIYLGSNRASGVPDRFSGSGSGTDFKLQISRVEAEDVGIYYCMQG RQFPYSFGQGTKVEIK |
| 139102- aa Full CAR | 145 | MALPVTALLLPLALLLHAARPQVQLVQSGAEVKKPGASVKVSCKASGY TFSNYGITWVRQAPGQGLEWMGWISAYNGNTNYAQKFQGRVTMTRNTS ISTAYMELSSLRSEDTAVYYCARGPYYYYMDVWGKGTMVTVSSASGGG GSGGGRASGGGGSEIVMTQSPLSLPVTPGEPASISCRSSQSLLYSNGYN YVDWYLQKPGQSPQLLIYLGSNRASGVPDRFSGSGSGTDFKLQISRVE AEDVGIYYCMQGRQFPYSFGQGTKVEIKTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR |
| 139102- nt Full CAR | 146 | ATGGCCCTCCCTGTCACCGCCCTGCTGCTTCCGCTGGCTCTTCTGCTC CACGCCGCTCGGCCCCAAGTCCAACTGGTCCAGAGCGGTGCAGAAGTG AAGAAGCCCGGAGCGAGCGTGAAAGTGTCCTGCAAGGCTTCCGGGTAC ACCTTCTCCAACTACGGCATCACTTGGGTGCGCCAGGCCCCGGGACAG GGCCTGGAATGGATGGGGTGGATTTCCGCGTACAACGGCAATACGAAC TACGCTCAGAAGTTCCAGGGTAGAGTGACCATGACTAGGAACACCTCC ATTTCCACCGCCTACATGGAACTGTCCTCCCTGCGGAGCGAGGACACC GCCGTGTACTATTGCGCCCGGGGACCATACTACTACTACATGGATGTC TGGGGGAAGGGGACTATGGTCACCGTGTCATCCGCCTCGGGAGGCGGC GGATCAGGAGGACGCGCCTCTGGTGGTGGAGGATCGGAGATCGTGATG ACCCAGAGCCCTCTCTCCTTGCCCGTGACTCCTGGGGAGCCCGCATCC ATTTCATGCCGGAGCTCCCAGTCACTTCTCTACTCCAACGGCTATAAC TACGTGGATTGGTACCTCCAAAAGCCGGGCCAGAGCCCGCAGCTGCTG ATCTACCTGGGCTCGAACAGGGCCAGCGGAGTGCCTGACCGGTTCTCC GGGTCGGGAAGCGGGACCGACTTCAAGCTGCAAATCTCGAGAGTGGAG GCCGAGGACGTGGGAATCTACTACTGTATGCAGGGCCGCCAGTTTCCG TACTCGTTCGGACAGGGCACCAAAGTGGAAATCAAGACCACTACCCCA GCACCGAGGCCACCCACCCCGGCTCCTACCATCGCCTCCCAGCCTCTG TCCCTGCGTCCGGAGGCATGTAGACCCGCAGCTGGTGGGGCCGTGCAT ACCCGGGGTCTTGACTTCGCCTGCGATATCTACATTTGGGCCCCTCTG GCTGGTACTTGCGGGGTCCTGCTGCTTTCACTCGTGATCACTCTTTAC TGTAAGCGCGGTCGGAAGAAGCTGCTGTACATCTTTAAGCAACCCTTC ATGAGGCCTGTGCAGACTACTCAAGAGGAGGACGGCTGTTCATGCCGG TTCCCAGAGGAGGAGGAAGGCGGCTGCGAACTGCGCGTGAAATTCAGC CGCAGCGCAGATGCTCCAGCCTACAAGCAGGGGCAGAACCAGCTCTAC AACGAACTCAATCTTGGTCGGAGAGAGGAGTACGACGTGCTGGACAAG |

TABLE 8-continued

Amino Acid and Nucleic Acid Sequences of exemplary anti-BCMA scFv domains and BCMA CAR molecules

| Name/ Description | SEQ ID NO: | Sequence |
| --- | --- | --- |
| | | CGGAGAGGACGGGACCCAGAAATGGGCGGGAAGCCGCGCAGAAAGAAT CCCCAAGAGGGCCTGTACAACGAGCTCCAAAAGGATAAGATGGCAGAA GCCTATAGCGAGATTGGTATGAAAGGGGAACGCAGAAGAGGCAAAGGC CACGACGGACTGTACCAGGGACTCAGCACCGCCACCAAGGACACCTAT GACGCTCTTCACATGCAGGCCCTGCCGCCTCGG |
| | | 139104 |
| 139104- aa ScFv domain | 147 | EVQLLETGGGLVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSSASGGGGSGGRASGGGGSEIVLTQSPATLS VSPGESATLSCRASQSVSSNLAWYQQKPGQAPRLLIYGASTRASGIPD RFSGSGSGTDFTLTISSLQAEDVAVYYCQQYGSSLTFGGGTKVEIK |
| 139104- nt ScFv domain | 148 | GAAGTGCAATTGCTCGAAACTGGAGGAGGTCTGGTGCAACCTGGAGGA TCACTTCGCCTGTCCTGCGCCGTGTCGGGCTTTGCCCTGTCCAACCAT GGAATGAGCTGGGTCCGCCGCGCGCCGGGGAAGGGCCTCGAATGGGTG TCCGGCATCGTCTACTCCGGCTCCACCTACTACGCCGCGTCCGTGAAG GGCCGGTTCACGATTTCACGGGACAACTCGCGGAACACCCTGTACCTC CAAATGAATTCCCTTCGGCCGGAGGATACTGCCATCTACTACTGCTCC GCCCACGGTGGCGAATCCGACGTCTGGGGCCAGGGAACCACCGTGACC GTGTCCAGCGCGTCCGGGGGAGGAGGAAGCGGGGGTAGAGCATCGGGT GGAGGCGGATCAGAGATCGTGCTGACCCAGTCCCCCGCCACCTTGAGC GTGTCACCAGGAGAGTCCGCCACCCTGTCATGCCGCGCCAGCCAGTCC GTGTCCTCCAACCTGGCTTGGTACCAGCAGAAGCCGGGGCAGGCCCCT AGACTCCTGATCTATGGGCGTCGACCCGGGCATCTGGAATTCCCGAT AGGTTCAGCGGATCGGGCTCGGGCACTGACTTCACTCTGACCATCTCC TCGCTGCAAGCCGAGGACGTGGCTGTGTACTACTGTCAGCAGTACGGA AGCTCCCTGACTTTCGGTGGCGGGACCAAAGTCGAGATTAAG |
| 139104- aa VH | 149 | EVQLLETGGGLVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSS |
| 139104- aa VL | 150 | EIVLTQSPATLSVSPGESATLSCRASQSVSSNLAWYQQKPGQAPRLLI YGASTRASGIPDRFSGSGSGTDFTLTISSLQAEDVAVYYCQQYGSSLT FGGGTKVEIK |
| 139104- aa Full CAR | 151 | MALPVTALLLPLALLLHAARPEVQLLETGGGLVQPGGSLRLSCAVSGF ALSNHGMSWVRRAPGKGLEWVSGIVYSGSTYYAASVKGRFTISRDNSR NTLYLQMNSLRPEDTAIYYCSAHGGESDVWGQGTTVTVSSASGGGGSG GRASGGGGSEIVLTQSPATLSVSPGESATLSCRASQSVSSNLAWYQQK PGQAPRLLIYGASTRASGIPDRFSGSGSGTDFTLTISSLQAEDVAVYY CQQYGSSLTFGGGTKVEIKTTTPAPRPPTPAPTIASQPLSLRPEACRP AAGGAVHTRGLDFACDIYIWAPLAGTCGVLLLSLVITLYCKRGRKKLL YIFKQPFMRPVQTTQEEDGCSCRFPEEEEGGCELRVKFSRSADAPAYK QGQNQLYNELNLGRREEYDVLDKRRGRDPEMGGKPRRKNPQEGLYNEL QKDKMAEAYSEIGMKGERRRGKGHDGLYQGLSTATKDTYDALHMQALP PR |
| 139104- nt Full CAR | 152 | ATGGCCCTCCCTGTCACCGCCCTGCTGCTTCCGCTGGCTCTTCTGCTC CACGCCGCTCGGCCCGAAGTGCAATTGCTCGAAACTGGAGGAGGTCTG GTGCAACCTGGAGGATCACTTCGCCTGTCCTGCGCCGTGTCGGGCTTT GCCCTGTCCAACCATGGAATGAGCTGGGTCCGCCGCGCGCCGGGGAAG GGCCTCGAATGGGTGTCCGGCATCGTCTACTCCGGCTCCACCTACTAC GCCGCGTCCGTGAAGGGCCGGTTCACGATTTCACGGGACAACTCGCGG AACACCCTGTACCTCCAAATGAATTCCCTTCGGCCGGAGGATACTGCC ATCTACTACTGCTCCGCCCACGGTGGCGAATCCGACGTCTGGGGCCAG GGAACCACCGTGACCGTGTCCAGCGCGTCCGGGGGAGGAGGAAGCGGG GGTAGAGCATCGGGTGGAGGCGGATCAGAGATCGTGCTGACCCAGTCC CCCGCCACCTTGAGCGTGTCACCAGGAGAGTCCGCCACCCTGTCATGC CGCGCCAGCCAGTCCGTGTCCTCCAACCTGGCTTGGTACCAGCAGAAG CCGGGGCAGGCCCCTAGACTCCTGATCTATGGGCGTCGACCCGGGCA TCTGGAATTCCCGATAGGTTCAGCGGATCGGGCTCGGGCACTGACTTC ACTCTGACCATCTCCTCGCTGCAAGCCGAGGACGTGGCTGTGTACTAC TGTCAGCAGTACGGAAGCTCCCTGACTTTCGGTGGCGGGACCAAAGTC GAGATTAAGACCACTACCCCAGCACCGAGGCCACCCACCCCGGCTCCT ACCATCGCCTCCCAGCCTCTGTCCCTGCGCTCCGGAGGCATGTAGACCC GCAGCTGGTGGGGCCGTGCATACCCGGGGTCTTGACTTCGCCTGCGAT ATCTACATTTGGGCCCCTCGGCTGGTACTTGCGGGGTCCTGCTGCTT TCACTCGTGATCACTCTTTACTGTAAGCGCGGTCGGAAGAAGCTGCTG TACATCTTTAAGCAACCCTTCATGAGGCCTGTGCAGACTACTCAAGAG GAGGACGGCTGTTCATGCCGGTTCCCAGAGGAGGAGGAAGGCGGCTGC |

TABLE 8-continued

Amino Acid and Nucleic Acid Sequences of exemplary anti-BCMA scFv domains and BCMA CAR molecules

| Name/Description | SEQ ID NO: | Sequence |
|---|---|---|
| | | GAACTGCGCGTGAAATTCAGCCGCAGCGCAGATGCTCCAGCCTACAAG<br>CAGGGGCAGAACCAGCTCTACAACGAACTCAATCTTGGTCGGAGAGAG<br>GAGTACGACGTGCTGGACAAGCGGAGAGGACGGGACCCAGAAATGGGC<br>GGGAAGCCGCGCAGAAAGAATCCCCAAGAGGGCCTGTACAACGAGCTC<br>CAAAAGGATAAGATGGCAGAAGCCTATAGCGAGATTGGTATGAAAGGG<br>GAACGCAGAAGAGGCAAAGGCCACGACGGACTGTACCAGGGACTCAGC<br>ACCGCCACCAAGGACACCTATGACGCTCTTCACATGCAGGCCCTGCCG<br>CCTCGG |

139106

| Name/Description | SEQ ID NO: | Sequence |
|---|---|---|
| 139106-aa ScFv domain | 153 | EVQLVETGGGLVQPGGSLRLSCAVSGFALSNHGMSWVRRAPGKGLEWV<br>SGIVYSGSTYYAASVKGRFTISRDNSRNTLYLQMNSLRPEDTAIYYCS<br>AHGGESDVWGQGTTVTVSSASGGGGSGGRASGGGGSEIVMTQSPATLS<br>VSPGERATLSCRASQSVSSKLAWYQQKPGQAPRLLMYGASIRATGIPD<br>RFSGSGSGTEFTLTISSLEPEDFAVYYCQQYGSSSWTFGQGTKVEIK |
| 139106-nt ScFv domain | 154 | GAAGTGCAATTGGTGGAAACTGGAGGAGGACTTGTGCAACCTGGAGGA<br>TCATTGAGACTGAGCTGCGCAGTGTCGGGATTCGCCCTGAGCAACCAT<br>GGAATGTCCTGGGTCAGAAGGGCCCCTGGAAAAGGCCTCGAATGGGTG<br>TCAGGGATCGTGTACTCCGGTTCCACTTACTACGCCGCCTCCGTGAAG<br>GGGCGCTTCACTATCTCACGGGATAACTCCCGCAATACCCTGTACCTC<br>CAAATGAACAGCCTGCGGCCGGAGGATACCGCCATCTACTACTGTTCC<br>GCCCACGGTGGAGAGTCTGACGTCTGGGGCCAGGGAACTACCGTGACC<br>GTGTCCTCCGCGTCCGGCGGTGGAGGGAGCGGCGGCCGCGCCAGCGGC<br>GGCGGAGGCTCCGAGATCGTGATGACCCAGAGCCCCGCTACTCTGTCG<br>GTGTCGCCCGGAGAAAGGGCGACCCTGTCCTGCCGGGCGTCGCAGTCC<br>GTGAGCAGCAAGCTGGCTTGGTACCAGCAGAAGCCGGGCCAGGCACCA<br>CGCCTGCTTATGTACGGTGCCTCCATTCGGGCCACCGGAATCCCGGAC<br>CGGTTCTCGGGGTCGGGGTCCGGTACCGAGTTCACACTGACCATTTCC<br>TCGCTCGAGCCCGAGGACTTTGCCGTCTATTACTGCCAGCAGTACGGC<br>TCCTCCTCATGGACGTTCGGCCAGGGGACCAAGGTCGAAATCAAG |
| 139106-aa VH | 155 | EVQLVETGGGLVQPGGSLRLSCAVSGFALSNHGMSWVRRAPGKGLEWV<br>SGIVYSGSTYYAASVKGRFTISRDNSRNTLYLQMNSLRPEDTAIYYCS<br>AHGGESDVWGQGTTVTVSS |
| 139106-aa VL | 156 | EIVMTQSPATLSVSPGERATLSCRASQSVSSKLAWYQQKPGQAPRLLM<br>YGASIRATGIPDRFSGSGSGTEFTLTISSLEPEDFAVYYCQQYGSSSW<br>TFGQGTKVEIK |
| 139106-aa Full CAR | 157 | MALPVTALLLPLALLLHAARPEVQLVETGGGLVQPGGSLRLSCAVSGF<br>ALSNHGMSWVRRAPGKGLEWVSGIVYSGSTYYAASVKGRFTISRDNSR<br>NTLYLQMNSLRPEDTAIYYCSAHGGESDVWGQGTTVTVSSASGGGGSG<br>GRASGGGGSEIVMTQSPATLSVSPGERATLSCRASQSVSSKLAWYQQK<br>PGQAPRLLMYGASIRATGIPDRFSGSGSGTEFTLTISSLEPEDFAVYY<br>CQQYGSSSWTFGQGTKVEIKTTTPAPRPPTPAPTIASQPLSLRPEACR<br>PAAGGAVHTRGLDFACDIYIWAPLAGTCGVLLLSLVITLYCKRGRKKL<br>LYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQAL<br>PPR |
| 139106-nt Full CAR | 158 | ATGGCCCTCCCTGTCACCGCCCTGCTGCTTCCGCTGGCTCTTCTGCTC<br>CACGCCGCTCGGCCCGAAGTGCAATTGGTGGAAACTGGAGGAGGACTT<br>GTGCAACCTGGAGGATCATTGAGACTGAGCTGCGCAGTGTCGGGATTC<br>GCCCTGAGCAACCATGGAATGTCCTGGGTCAGAAGGGCCCCTGGAAAA<br>GGCCTCGAATGGGTGTCAGGGATCGTGTACTCCGGTTCCACTTACTAC<br>GCCGCCTCCGTGAAGGGGCGCTTCACTATCTCACGGGATAACTCCCGC<br>AATACCCTGTACCTCCAAATGAACAGCCTGCGGCCGGAGGATACCGCC<br>ATCTACTACTGTTCCGCCCACGGTGGAGAGTCTGACGTCTGGGGCCAG<br>GGAACTACCGTGACCGTGTCCTCCGCGTCCGGCGGTGGAGGGAGCGGC<br>GGCCGCGCCAGCGGCGGCGGAGGCTCCGAGATCGTGATGACCCAGAGC<br>CCCGCTACTCTGTCGGTGTCGCCCGGAGAAAGGGCGACCCTGTCCTGC<br>CGGGCGTCGCAGTCCGTGAGCAGCAAGCTGGCTTGGTACCAGCAGAAG<br>CCGGGCCAGGCACCACGCCTGCTTATGTACGGTGCCTCCATTCGGGCC<br>ACCGGAATCCCGGACCGGTTCTCGGGGTCGGGGTCCGGTACCGAGTTC<br>ACACTGACCATTTCCTCGCTCGAGCCCGAGGACTTTGCCGTCTATTAC<br>TGCCAGCAGTACGGCTCCTCCTCATGGACGTTCGGCCAGGGGACCAAG<br>GTCGAAATCAAGACCACTACCCCAGCACCGAGGCACCCACCCCGGCT<br>CCTACCATCGCCTCCCAGCCTCTGTCCCTGCGTCCGGAGGCATGTAGA<br>CCCGCAGCTGGTGGGGCCGTGCATACCCGGGGTCTTGACTTCGCCTGC<br>GATATCTACATTTGGGCCCCTCTGGCTGGTACTTGCGGGGTCCTGCTG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | CTTTCACTCGTGATCACTCTTTACTGTAAGCGCGGTCGGAAGAAGCTG CTGTACATCTTTAAGCAACCCTTCATGAGGCCTGTGCAGACTACTCAA GAGGAGGACGGCTGTTCATGCCGGTTCCCAGAGGAGGAGGAAGGCGGC TGCGAACTGCGCGTGAAATTCAGCCGCAGCGCAGATGCTCCAGCCTAC AAGCAGGGGCAGAACCAGCTCTACAACGAACTCAATCTTGGTCGGAGA GAGGAGTACGACGTGCTGGACAAGCGGAGAGGACGGGACCCAGAAATG GGCGGGAAGCCGCGCAGAAAGAATCCCCAAGAGGGCCTGTACAACGAG CTCCAAAAGGATAAGATGGCAGAAGCCTATAGCGAGATTGGTATGAAA GGGGAACGCAGAAGAGGCAAAGGCCACGACGGACTGTACCAGGGACTC AGCACCGCCACCAAGGACACCTATGACGCTCTTCACATGCAGGCCCTG CCGCCTCGG |

139107

| 139107- aa ScFv domain | 159 | EVQLVETGGGVVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSSASGGGGSGGRASGGGGSEIVLTQSPGTLS LSPGERATLSCRASQSVGSTNLAWYQQKPGQAPRLLIYDASNRATGIP DRFSGGGSGTDFTLTISRLEPEDFAVYYCQQYGSSPPWTFGQGTKVEI K |
| 139107- nt ScFv domain | 160 | GAAGTGCAATTGGTGGAGACTGGAGGAGGAGTGGTGCAACCTGGAGGA AGCCTGAGACTGTCATGCGCGGTGTCGGGCTTCGCCCTCTCCAACCAC GGAATGTCCTGGGTCCGCCGGGCCCCTGGGAAAGGACTTGAATGGGTG TCCGGCATCGTGTACTCGGGTTCCACCTACTACGCGGCCTCAGTGAAG GGCCGGTTTACTATTAGCCGCGACAACTCCAGAAACACACTGTACCTC CAAATGAACTCGCTGCGGCCGGAAGATACCGCTATCTACTACTGCTCC GCCCATGGGGGAGAGTCGGACGTCTGGGGACAGGGCACCACTGTCACT GTGTCCAGCGCTTCCGGCGGTGGTGGAAGCGGGGACGGGCCTCAGGA GGCGGTGGCAGCGAGATTGTGCTGACCCAGTCCCCCGGGACCCTGAGC CTGTCCCCGGGAGAAAGGGCCACCCTCTCCTGTCGGGCATCCCAGTCC GTGGGGTCTACTAACCTTGCATGGTACCAGCAGAAGCCCGGCCAGGCC CCTCGCCTGCTGATCTACGACGCGTCAATAGAGCCACCGGCATCCCG GATCGCTTCAGCGGAGGCGGATCGGGCACCGACTTCACCCTCACCATT TCAAGGCTGGAACCGGAGGACTTCGCCGTGTACTACTGCCAGCAGTAT GGTTCGTCCCCACCCTGGACGTTCGGCCAGGGGACTAAGGTCGAGATC AAG |
| 139107- aa VH | 161 | EVQLVETGGGVVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSS |
| 139107- aa VL | 162 | EIVLTQSPGTLSLSPGERATLSCRASQSVGSTNLAWYQQKPGQAPRLL IYDASNRATGIPDRFSGGGSGTDFTLTISRLEPEDFAVYYCQQYGSSP PWTFGQGTKVEIK |
| 139107- aa Full CAR | 163 | MALPVTALLLPLALLLHAARPEVQLVETGGGVVQPGGSLRLSCAVSGF ALSNHGMSWVRRAPGKGLEWVSGIVYSGSTYYAASVKGRFTISRDNSR NTLYLQMNSLRPEDTAIYYCSAHGGESDVWGQGTTVTVSSASGGGGSG GRASGGGGSEIVLTQSPGTLSLSPGERATLSCRASQSVGSTNLAWYQQ KPGQAPRLLIYDASNRATGIPDRFSGGGSGTDFTLTISRLEPEDFAVY YCQQYGSSPPWTFGQGTKVEIKTTTPAPRPPTPAPTIASQPLSLRPEA CRPAAGGAVHTRGLDFACDIYIWAPLAGTCGVLLLSLVITLYCKRGRK KLLYIFKQPFMRPVQTTQEEDGCSCRFPEEEEGGCELRVKFSRSADAP AYKQGQNQLYNELNLGRREEYDVLDKRRGRDPEMGGKPRRKNPQEGLY NELQKDKMAEAYSEIGMKGERRRGKGHDGLYQGLSTATKDTYDALHMQ ALPPR |
| 139107- nt Full CAR | 164 | ATGGCCCTCCCTGTCACCGCCCTGCTGCTTCCGCTGGCTCTTCTGCTC CACGCCGCTCGGCCCGAAGTGCAATTGGTGGAGACTGGAGGAGGAGTG GTGCAACCTGGAGGAAGCCTGAGACTGTCATGCGCGGTGTCGGGCTTC GCCCTCTCCAACCACGGAATGTCCTGGGTCCGCCGGGCCCCTGGGAAA GGACTTGAATGGGTGTCCGGCATCGTGTACTCGGGTTCCACCTACTAC GCGGCCTCAGTGAAGGGCCGGTTTACTATTAGCCGCGACAACTCCAGA AACACACTGTACCTCCAAATGAACTCGCTGCGGCCGGAAGATACCGCT ATCTACTACTGCTCCGCCCATGGGGGAGAGTCGGACGTCTGGGGACAG GGCACCACTGTCACTGTGTCCAGCGCTTCCGGCGGTGGTGGAAGCGGG GACGGGCCTCAGGAGGCGGTGGCAGCGAGATTGTGCTGACCCAGTCC CCCGGGACCCTGAGCCTGTCCCCGGGAGAAAGGGCCACCCTCTCCTGT CGGGCATCCCAGTCCGTGGGGTCTACTAACCTTGCATGGTACCAGCAG AAGCCCGGCCAGGCCCCTCGCCTGCTGATCTACGACGCGTCAATAGA GCCACCGGCATCCCGGATCGCTTCAGCGGAGGCGGATCGGGCACCGAC TTCACCCTCACCATTTCAAGGCTGGAACCGGAGGACTTCGCCGTGTAC |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | TACTGCCAGCAGTATGGTTCGTCCCCACCCTGGACGTTCGGCCAGGGG<br>ACTAAGGTCGAGATCAAGACCACTACCCCAGCACCGAGGCCACCCACC<br>CCGGCTCCTACCATCGCCTCCCAGCCTCTGTCCCTGCGTCCGGAGGCA<br>TGTAGACCCGCAGCTGGTGGGGCCGTGCATACCCGGGTCTTGACTTC<br>GCCTGCGATATCTACATTTGGGCCCCTCTGGCTGGTACTTGCGGGGTC<br>CTGCTGCTTTCACTCGTGATCACTCTTTACTGTAAGCGCGGTCGGAAG<br>AAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAA<br>GGCGGCTGCGAACTGCGCGTGAAATTCAGCCGCAGCGCAGATGCTCCA<br>GCCTACAAGCAGGGGCAGAACCAGCTCTACAACGAACTCAATCTTGGT<br>CGGAGAGAGGAGTACGACGTGCTGGACAAGCGGAGAGGACGGGACCCA<br>GAAATGGGCGGGAAGCCGCGCAGAAAGAATCCCCAAGAGGGCCTGTAC<br>AACGAGCTCCAAAAGGATAAGATGGCAGAAGCCTATAGCGAGATTGGT<br>ATGAAAGGGGAACGCAGAAGAGGCAAAGGCCACGACGGACTGTACCAG<br>GGACTCAGCACCGCCACCAAGGACACCTATGACGCTCTTCACATGCAG<br>GCCCTGCCGCCTCGG |
| | | 139108 |
| 139108- aa ScFv domain | 165 | QVQLVESGGGLVKPGGSLRLSCAASGFTFSDYYMSWIRQAPGKGLEWV<br>SYISSSGSTIYYADSVKGRFTISRDNAKNSLYLQMNSLRAEDTAVYYC<br>ARESGDGMDVWGQGTTVTVSSASGGGGSGGRASGGGGSDIQMTQSPSS<br>LSASVGDRVTITCRASQSISSYLNWYQQKPGKAPKLLIYAASSLQSGV<br>PSRFSGSGSGTDFTLTISSLQPEDFATYYCQQSYTLAFGQGTKVDIK |
| 139108- nt ScFv domain | 166 | CAAGTGCAACTCGTGGAATCTGGTGGAGGACTCGTGAAACCTGGAGGA<br>TCATTGAGACTGTCATGCGCGGCCTCGGGATTCACGTTCTCCGATTAC<br>TACATGAGCTGGATTCGCCAGGCTCCGGGGAAGGGACTGGAATGGGTG<br>TCCTACATTTCCTCATCCGGCTCCACCATCTACTACGCGGACTCCGTG<br>AAGGGGAGATTCACCATTAGCCGCGATAACGCCAAGAACAGCCTGTAC<br>CTTCAGATGAACTCCCTGCGGGCTGAAGATACTGCCGTCTACTACTGC<br>GCAAGGGAGAGCGGAGATGGGATGGACGTCTGGGGACAGGGTACCACT<br>GTGACCGTGTCGTCGGCCTCCGGCGGAGGGGGTTCGGGTGGAAGGGCC<br>AGCGGCGGCGGAGGCAGCGACATCCAGATGACCCAGTCCCCCTCATCG<br>CTGTCCGCCTCCGTGGGCGACCGCGTCACCATCACATGCCGGGCCTCA<br>CAGTCGATCTCCTCCTACCTCAATTGGTATCAGCAGAAGCCCGGAAAG<br>GCCCCTAAGCTTCTGATCTACGCAGCGTCCTCCCTGCAATCCGGGGTC<br>CCATCTCGGTTCTCCGGCTCGGGCAGCGGTACCGACTTCACTCTGACC<br>ATCTCGAGCCTGCAGCCGGAGGACTTCGCCACTTACTACTGTCAGCAA<br>AGCTACACCCTCGCGTTTGGCCAGGGCACCAAAGTGGACATCAAG |
| 139108- aa VH | 167 | QVQLVESGGGLVKPGGSLRLSCAASGFTFSDYYMSWIRQAPGKGLEWV<br>SYISSSGSTIYYADSVKGRFTISRDNAKNSLYLQMNSLRAEDTAVYYC<br>ARESGDGMDVWGQGTTVTVSS |
| 139108- aa VL | 168 | DIQMTQSPSSLSASVGDRVTITCRASQSISSYLNWYQQKPGKAPKLLI<br>YAASSLQSGVPSRFSGSGSGTDFTLTISSLQPEDFATYYCQQSYTLAF<br>GQGTKVDIK |
| 139108- aa Full CAR | 169 | MALPVTALLLPLALLLHAARPQVQLVESGGGLVKPGGSLRLSCAASGF<br>TFSDYYMSWIRQAPGKGLEWVSYISSSGSTIYYADSVKGRFTISRDNA<br>KNSLYLQMNSLRAEDTAVYYCARESGDGMDVWGQGTTVTVSSASGGGG<br>SGGRASGGGGSDIQMTQSPSSLSASVGDRVTITCRASQSISSYLNWYQ<br>QKPGKAPKLLIYAASSLQSGVPSRFSGSGSGTDFTLTISSLQPEDFAT<br>YYCQQSYTLAFGQGTKVDIKTTTPAPRPPTPAPTIASQPLSLRPEACR<br>PAAGGAVHTRGLDFACDIYIWAPLAGTGVLLLSLVITLYCKRGRKKL<br>LYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQAL<br>PPR |
| 139108- nt Full CAR | 170 | ATGGCCCTCCCTGTCACCGCCCTGCTGCTTCCGCTGGCTCTTCTGCTC<br>CACGCCGCTCGGCCCCAAGTGCAACTCGTGGAATCTGGTGGAGGACTC<br>GTGAAACCTGGAGGATCATTGAGACTGTCATGCGCGGCCTCGGGATTC<br>ACGTTCTCCGATTACTACATGAGCTGGATTCGCCAGGCTCCGGGGAAG<br>GGACTGGAATGGGTGTCCTACATTTCCTCATCCGGCTCCACCATCTAC<br>TACGCGGACTCCGTGAAGGGGAGATTCACCATTAGCCGCGATAACGCC<br>AAGAACAGCCTGTACCTTCAGATGAACTCCCTGCGGGCTGAAGATACT<br>GCCGTCTACTACTGCGCAAGGGAGAGCGGAGATGGGATGGACGTCTGG<br>GGACAGGGTACCACTGTGACCGTGTCGTCGGCCTCCGGCGGAGGGGGT<br>TCGGGTGGAAGGGCCAGCGGCGGCGGAGGCAGCGACATCCAGATGACC<br>CAGTCCCCCTCATCGCTGTCCGCCTCCGTGGGCGACCGCGTCACCATC<br>ACATGCCGGGCCTCACAGTCGATCTCCTCCTACCTCAATTGGTATCAG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
|  |  | CAGAAGCCCGGAAAGGCCCCTAAGCTTCTGATCTACGCAGCGTCCTCC CTGCAATCCGGGGTCCCATCTCGGTTCTCCGGCTCGGGCAGCGGTACC GACTTCACTCTGACCATCTCGAGCCTGCAGCCGGAGGACTTCGCCACT TACTACTGTCAGCAAAGCTACACCCTCGCGTTTGGCCAGGGCACCAAA GTGGACATCAAGACCACTACCCCAGCACCGAGGCCACCCACCCCGGCT CCTACCATCGCCTCCCAGCCTCTGTCCCTGCGTCCGGAGGCATGTAGA CCCGCAGCTGGTGGGGCCGTGCATACCCGGGGTCTTGACTTCGCCTGC GATATCTACATTTGGGCCCCTCTGGCTGGTACTTGCGGGGTCCTGCTG CTTTCACTCGTGATCACTCTTTACTGTAAGCGCGGTCGGAAGAAGCTG CTGTACATCTTTAAGCAACCCTTCATGAGGCCTGTGCAGACTACTCAA GAGGAGGACGGCTGTTCATGCCGGTTCCCAGAGGAGGAGGAAGGCGGC TGCGAACTGCGCGTGAAATTCAGCCGCAGCGCAGATGCTCCAGCCTAC AAGCAGGGGCAGAACCAGCTCTACAACGAACTCAATCTTGGTCGGAGA GAGGAGTACGACGTGCTGGACAAGCGGAGAGGACGGGACCCAGAAATG GGCGGGAAGCCGCGCAGAAAGAATCCCCAAGAGGGCCTGTACAACGAG CTCCAAAAGGATAAGATGGCAGAAGCCTATAGCGAGATTGGTATGAAA GGGGAACGCAGAAGAGGCAAAGGCCACGACGGACTGTACCAGGGACTC AGCACCGCCACCAAGGACACCTATGACGCTCTTCACATGCAGGCCCTG CCGCCTCGG |
|  |  | 139110 |
| 139110- aa ScFv domain | 171 | QVQLVQSGGGLVKPGGSLRLSCAASGFTFSDYYMSWIRQAPGKGLEWV SYISSSGNTIYYADSVKGRFTISRDNAKNSLYLQMNSLRAEDTAVYYC ARSTMVREDYWGQGTLVTVSSASGGGGSGGRASGGGGSDIVLTQSPLS LPVTLGQPASISCKSSESLVHNSGKTYLNWFHQRPGQSPRRLIYEVSN RDSGVPDRFTGSGSGTDFTLKISRVEAEDVGVYYCMQGTHWPGTFGQG TKLEIK |
| 139110- nt ScFv domain | 172 | CAAGTGCAACTGGTGCAAAGCGGAGGAGGATTGGTCAAACCCGGAGGA AGCCTGAGACTGTCATGCGCGGCCTCTGGATTCACCTTCTCCGATTAC TACATGTCATGGATCAGACAGGCCCCGGGGAAGGGCCTCGAATGGGTG TCCTACATCTCGTCCTCCGGGAACACCATCTACTACGCCGACAGCGTG AAGGGCCGCTTTACCATTTCCCGCGACAACGCAAAGAACTCGCTGTAC CTTCAGATGAATTCCCTGCGGGCTGAAGATACCGCGGTGTACTATTGC GCCCGGTCCACTATGGTCCGGGAGGACTACTGGGGACAGGGCACACTC GTGACCGTGTCCAGCGCGAGCGGGGGTGGAGGCAGCGGTGGACGCGCC TCCGGCGGCGGCGGTTCAGACATCGTGCTGACTCAGTCGCCCCTGTCG CTGCCGGTCACCCTGGGCCAACCGGCCTCAATTAGCTGCAAGTCCTCG GAGAGCCTGGTGCACAACTCAGGAAAGACTTACCTGAACTGGTTCCAT CAGCGGCCTGGACAGTCCCCACGGAGGCTCATCTATGAAGTGTCCAAC AGGGATTCGGGGGTGCCCGACCGCTTCACTGGCTCCGGGTCCGGCACC GACTTCACCTTGAAAATCTCCAGAGTGGAAGCCGAGGACGTGGGCGTG TACTACTGTATGCAGGGTACCCACTGGCCTGGAACCTTTGGACAAGGA ACTAAGCTCGAGATTAAG |
| 139110- aa VH | 173 | QVQLVQSGGGLVKPGGSLRLSCAASGFTFSDYYMSWIRQAPGKGLEWV SYISSSGNTIYYADSVKGRFTISRDNAKNSLYLQMNSLRAEDTAVYYC ARSTMVREDYWGQGTLVTVSS |
| 139110- aa VL | 174 | DIVLTQSPLSLPVTLGQPASISCKSSESLVHNSGKTYLNWFHQRPGQS PRRLIYEVSNRDSGVPDRFTGSGSGTDFTLKISRVEAEDVGVYYCMQG THWPGTFGQGTKLEIK |
| 139110- aa Full CAR | 175 | MALPVTALLLPLALLLHAARPQVQLVQSGGGLVKPGGSLRLSCAASGF TFSDYYMSWIRQAPGKGLEWVSYISSSGNTIYYADSVKGRFTISRDNA KNSLYLQMNSLRAEDTAVYYCARSTMVREDYWGQGTLVTVSSASGGGG SGGRASGGGGSDIVLTQSPLSLPVTLGQPASISCKSSESLVHNSGKTY LNWFHQRPGQSPRRLIYEVSNRDSGVPDRFTGSGSGTDFTLKISRVEA EDVGVYYCMQGTHWPGTFGQGTKLEIKTTTPAPRPPTPAPTIASQPLS LRPEACRPAAGGAVHTRGLDFACDIYIWAPLAGTCGVLLLSLVITLYC KRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNP QEGLYNELQKDKMAEAYSEIGMKGERRRGKGHDGLYQGLSTATKDTYD ALHMQALPPR |
| 139110- nt Full CAR | 176 | ATGGCCCTCCCTGTCACCGCCCTGCTGCTTCCGCTGGCTCTTCTGCTC CACGCCGCTCGGCCCCAAGTGCAACTGGTGCAAAGCGGAGGAGGATTG GTCAAACCCGGAGGAAGCCTGAGACTGTCATGCGCGGCCTCTGGATTC ACCTTCTCCGATTACTACATGTCATGGATCAGACAGGCCCCGGGGAAG GGCCTCGAATGGGTGTCCTACATCTCGTCCTCCGGGAACACCATCTAC TACGCCGACAGCGTGAAGGGCCGCTTTACCATTTCCCGCGACAACGCA AAGAACTCGCTGTACCTTCAGATGAATTCCCTGCGGGCTGAAGATACC |

TABLE 8-continued

Amino Acid and Nucleic Acid Sequences of exemplary anti-BCMA scFv domains and BCMA CAR molecules

| Name/<br>Description | SEQ<br>ID<br>NO: | Sequence |
|---|---|---|
| | | GCGGTGTACTATTGCGCCCGGTCCACTATGGTCCGGGAGGACTACTGG<br>GGACAGGGCACACTCGTGACCGTGTCCAGCGCGAGCGGGGGTGGAGGC<br>AGCGGTGGACGCGCCTCCGGCGGCGGCGGTTCAGACATCGTGCTGACT<br>CAGTCGCCCCTGTCGCTGCCGGTCACCCTGGGCCAACCGGCCTCAATT<br>AGCTGCAAGTCCTCGGAGAGCCTGGTGCACAACTCAGGAAAGACTTAC<br>CTGAACTGGTTCCATCAGCGGCCTGGACAGTCCCCACGGAGGCTCATC<br>TATGAAGTGTCCAACAGGGATTCGGGGGTGCCCGACCGCTTCACTGGC<br>TCCGGGTCCGGCACCGACTTCACCTTGAAAATCTCCAGAGTGGAAGCC<br>GAGGACGTGGGCGTGTACTACTGTATGCAGGGTACCCACTGGCCTGGA<br>ACCTTTGGACAAGGAACTAAGCTCGAGATTAAGACCACTACCCCAGCA<br>CCGAGGCCACCCACCCCGGCTCCTACCATCGCCTCCCAGCCTCTGTCC<br>CTGCGTCCGGAGGCATGTAGACCCGCAGCTGGTGGGGCCGTGCATACC<br>CGGGGTCTTGACTTCGCCTGCGATATCTACATTTGGGCCCCTCTGGCT<br>GGTACTTGCGGGGTCCTGCTGCTTTCACTCGTGATCACTCTTTACTGT<br>AAGCGCGGTCGGAAGAAGCTGCTGTACATCTTTAAGCAACCCTTCATG<br>AGGCCTGTGCAGACTACTCAAGAGGAGGACGGCTGTTCATGCCGGTTC<br>CCAGAGGAGGAGGAAGGCGGCTGCGAACTGCGCGTGAAATTCAGCCGC<br>AGCGCAGATGCTCCAGCCTACAAGCAGGGCAGAACCAGCTCTACAAG<br>GAACTCAATCTTGGTCGGAGAGAGGAGTACGACGTGCTGGACAAGCGG<br>AGAGGACGGGACCCAGAAATGGGCGGGAAGCCGCGCAGAAAGAATCCC<br>CAAGAGGGCCTGTACAACGAGCTCCAAAAGGATAAGATGGCAGAAGCC<br>TATAGCGAGATTGGTATGAAAGGGAACGCAGAAGAGGCAAAGGCCAC<br>GACGGACTGTACCAGGGACTCAGCACCGCCACCAAGGACACCTATGAC<br>GCTCTTCACATGCAGGCCCTGCCGCCTCGG |

139112

| 139112- aa<br>ScFv<br>domain | 177 | QVQLVESGGGLVQPGGSLRLSCAVSGFALSNHGMSWVRRAPGKGLEWV<br>SGIVYSGSTYYAASVKGRFTISRDNSRNTLYLQMNSLRPEDTAIYYCS<br>AHGGESDVWGQGTTVTVSSASGGGGSGGRASGGGGSDIRLTQSPSPLS<br>ASVGDRVTITCQASEDINKFLNWYHQTPGKAPKLLIYDASTLQTGVPS<br>RFSGSGSGTDFTLTINSLQPEDIGTYYCQQYESLPLTFGGGTKVEIK |
| 139112- nt<br>ScFv<br>domain | 178 | CAAGTGCAACTCGTGGAATCTGGTGGAGGACTCGTGCAACCCGGTGGA<br>AGCCTTAGGCTGTCGTGCGCCGTCAGCGGGTTTGCTCTGAGCAACCAT<br>GGAATGTCCTGGGTCCGCCGGGCACCGGGAAAAGGGCTGGAATGGGTG<br>TCCGGCATCGTGTACAGCGGGTCAACCTATTACGCCGCGTCCGTGAAG<br>GGCAGATTCACTATCTCAAGAGACAACAGCCGGAACACCCTGTACTTG<br>CAAATGAATTCCCTGCGCCCCGAGGACACCGCCATCTACTACTGCTCC<br>GCCCACGGAGGAGAGTCGGACGTGTGGGGCCAGGGAACGACTGTGACT<br>GTGTCCAGCGCATCAGGAGGGGTGGTTCGGGCGGCGGGCCTCGGGG<br>GGAGGAGGTTCCGACATTCGGCTGACCCAGTCCCCGTCCCCACTGTCG<br>GCCTCCGTCGGCGACCGCGTGACCATCACTTGTCAGGCGTCCGAGGAC<br>ATTAACAAGTTCCTGAACTGGTACCACCAGACCCCTGGAAAGGCCCCC<br>AAGCTGCTGATCTACGATGCCTCGACCCTTCAAACTGGAGTGCCTAGC<br>CGGTTCTCCGGGTCCGGCTCCGGCACTGATTTCACTCTGACCATCAAC<br>TCATTGCAGCCGGAAGATATCGGGACCTACTATTGCCAGCAGTACGAA<br>TCCCTCCCGCTCACATTCGGCGGGGAACCAAGGTCGAGATTAAG |
| 139112- aa<br>VH | 179 | QVQLVESGGGLVQPGGSLRLSCAVSGFALSNHGMSWVRRAPGKGLEWV<br>SGIVYSGSTYYAASVKGRFTISRDNSRNTLYLQMNSLRPEDTAIYYCS<br>AHGGESDVWGQGTTVTVSS |
| 139112- aa<br>VL | 180 | DIRLTQSPSPLSASVGDRVTITCQASEDINKFLNWYHQTPGKAPKLLI<br>YDASTLQTGVPSRFSGSGSGTDFTLTINSLQPEDIGTYYCQQYESLPL<br>TFGGGTKVEIK |
| 139112- aa<br>Full CAR | 181 | MALPVTALLLPLALLLHAARPQVQLVESGGGLVQPGGSLRLSCAVSGF<br>ALSNHGMSWVRRAPGKGLEWVSGIVYSGSTYYAASVKGRFTISRDNSR<br>NTLYLQMNSLRPEDTAIYYCSAHGGESDVWGQGTTVTVSSASGGGGSG<br>GRASGGGGSDIRLTQSPSPLSASVGDRVTITCQASEDINKFLNWYHQT<br>PGKAPKLLIYDASTLQTGVPSRFSGSGSGTDFTLTINSLQPEDIGTYY<br>CQQYESLPLTFGGGTKVEIKTTTPAPRPPTPAPTIASQPLSLRPEACR<br>PAAGGAVHTRGLDFACDIYIWAPLAGTCGVLLLSLVITLYCKRGRKKL<br>LYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQAL<br>PPR |
| 139112- nt<br>Full CAR | 182 | ATGGCCCTCCCTGTCACCGCCCTGCTGCTTCCGCTGGCTCTTCTGCTC<br>CACGCCGCTCGGCCCCAAGTGCAACTCGTGGAATCTGGTGGAGGACTC<br>GTGCAACCCGGTGGAAGCCTTAGGCTGTCGTGCGCCGTCAGCGGGTTT<br>GCTCTGAGCAACCATGGAATGTCCTGGGTCCGCCGGGCACCGGGAAA |

TABLE 8-continued

Amino Acid and Nucleic Acid Sequences of exemplary anti-BCMA scFv domains and BCMA CAR molecules

| Name/ Description | SEQ ID NO: | Sequence |
| --- | --- | --- |
| | | GGGCTGGAATGGGTGTCCGGCATCGTGTACAGCGGGTCAACCTATTAC<br>GCCGCGTCCGTGAAGGGCAGATTCACTATCTCAAGAGACAACAGCCGG<br>AACACCCTGTACTTGCAAATGAATTCCCTGCGCCCCGAGGACACCGCC<br>ATCTACTACTGCTCCGCCCACGGAGGAGAGTCGGACGTGTGGGGCCAG<br>GGAACGACTGTGACTGTGTCCAGCGCATCAGGAGGGGGTGGTTCGGGC<br>GGCCGGGCCTCGGGGGGAGGAGGTTCCGACATTCGGCTGACCCAGTCC<br>CCGTCCCCACTGTCGGCCTCCGTCGGCGACCGCGTGACCATCACTTGT<br>CAGGCGTCCGAGGACATTAACAAGTTCCTGAACTGGTACCACCAGACC<br>CCTGGAAAGGCCCCCAAGCTGCTGATCTACGATGCCTCGACCCTTCAA<br>ACTGGAGTGCCTAGCCGGTTCTCCGGGTCCGGCTCCGGCACTGATTTC<br>ACTCTGACCATCAACTCATTGCAGCCGGAAGATATCGGGACCTACTAT<br>TGCCAGCAGTACGAATCCCTCCCGCTCACATTCGGCGGGGGAACCAAG<br>GTCGAGATTAAGACCACTACCCCAGCACCGAGGCCACCCACCCCGGCT<br>CCTACCATCGCCTCCCAGCCTCTGTCCCTGCGTCCGGAGGCATGTAGA<br>CCCGCAGCTGGTGGGGCCGTGCATACCCGGGGTCTTGACTTCGCCTGC<br>GATATCTACATTTGGGCCCCTCTGGCTGGTACTTGCGGGGTCCTGCTG<br>CTTTCACTCGTGATCACTCTTTACTGTAAGCGCGGTCGGAAGAAGCTG<br>CTGTACATCTTTAAGCAACCCTTCATGAGGCCTGTGCAGACTACTCAA<br>GAGGAGGACGGCTGTTCATGCCGGTTCCCAGAGGAGGAGGAAGGCGGC<br>TGCGAACTGCGCGTGAAATTCAGCCGCAGCGCAGATGCTCCAGCCTAC<br>AAGCAGGGGCAGAACCAGCTCTACAACGAACTCAATCTTGGTCGGAGA<br>GAGGAGTACGACGTGCTGGACAAGCGGAGAGGACGGGACCCAGAAATG<br>GGCGGGAAGCCGCGCAGAAAGAATCCCCAAGAGGGCCTGTACAACGAG<br>CTCCAAAAGGATAAGATGGCAGAAGCCTATAGCGAGATTGGTATGAAA<br>GGGGAACGCAGAAGAGGCAAAGGCCACGACGGACTGTACCAGGGACTC<br>AGCACCGCCACCAAGGACACCTATGACGCTCTTCACATGCAGGCCCTG<br>CCGCCTCGG |
| | | 139113 |
| 139113- aa ScFv domain | 183 | EVQLVETGGGLVQPGGSLRLSCAVSGFALSNHGMSWVRRAPGKGLEWV<br>SGIVYSGSTYYAASVKGRFTISRDNSRNTLYLQMNSLRPEDTAIYYCS<br>AHGGESDVWGQGTTVTVSSASGGGGSGGRASGGGGSETTLTQSPATLS<br>VSPGERATLSCRASQSVGSNLAWYQQKPGQGPRLLIYGASTRATGIPA<br>RFSGSGSGTEFTLTISSLQPEDFAVYYCQQYNDWLPVTFGQGTKVEIK |
| 139113- nt ScFv domain | 184 | GAAGTGCAATTGGTGGAAACTGGAGGAGGACTTGTGCAACCTGGAGGA<br>TCATTGCGGCTCTCATGCGCTGTCTCCGGCTTCGCCCTGTCAAATCAC<br>GGGATGTCGTGGGTCAGACGGGCCCCGGGAAAGGGTCTGGAATGGGTG<br>TCGGGGATTGTGTACAGCGGCTCCACCTACTACGCCGCTTCGGTCAAG<br>GGCCGCTTCACTATTTCACGGGACAACAGCCGCAACACCCTCTATCTG<br>CAAATGAACTCTCTCCGCCCGGAGGATACCGCCATCTACTACTGCTCC<br>GCACACGGCGGCGAATCCGACGTGTGGGACAGGGAACCACTGTCACC<br>GTGTCGTCCGCATCCGGTGGCGGAGGATCGGGTGGCCGGGCCTCCGGG<br>GGCGGCGGCAGCGAGACTACCCTGACCCAGTCCCCTGCCACTCTGTCC<br>GTGAGCCCGGGAGAGAGAGCCACCCTTAGCTGCCGGGCCAGCCAGAGC<br>GTGGGCTCCAACCTGGCCTGGTACCAGCAGAAGCCAGGACAGGGTCCC<br>AGGCTGCTGATCTACGGAGCCTCCACTCGCGCGACCGGCATCCCCGCG<br>AGGTTCTCCGGGTCGGGTTCCGGGACCGAGTTCACCCTGACCATCTCC<br>TCCCTCCAACCGGAGGACTTCGCGGTGTACTACTGTCAGCAGTACAAC<br>GATTGGCTGCCCGTGACATTTGGACAGGGGACGAAGGTGGAAATCAAA |
| 139113- aa VH | 185 | EVQLVETGGGLVQPGGSLRLSCAVSGFALSNHGMSWVRRAPGKGLEWV<br>SGIVYSGSTYYAASVKGRFTISRDNSRNTLYLQMNSLRPEDTAIYYCS<br>AHGGESDVWGQGTTVTVSS |
| 139113- aa VL | 186 | ETTLTQSPATLSVSPGERATLSCRASQSVGSNLAWYQQKPGQGPRLLI<br>YGASTRATGIPARFSGSGSGTEFTLTISSLQPEDFAVYYCQQYNDWLP<br>VTFGQGTKVEIK |
| 139113- aa Full CAR | 187 | MALPVTALLLPLALLLHAARPEVQLVETGGGLVQPGGSLRLSCAVSGF<br>ALSNHGMSWVRRAPGKGLEWVSGIVYSGSTYYAASVKGRFTISRDNSR<br>NTLYLQMNSLRPEDTAIYYCSAHGGESDVWGQGTTVTVSSASGGGGSG<br>GRASGGGGSETTLTQSPATLSVSPGERATLSCRASQSVGSNLAWYQQK<br>PGQGPRLLIYGASTRATGIPARFSGSGSGTEFTLTISSLQPEDFAVYY<br>CQQYNDWLPVTFGQGTKVEIKTTTPAPRPPTPAPTIASQPLSLRPEAC<br>RPAAGGAVHTRGLDFACDIYIWAPLAGTCGVLLLSLVITLYCKRGRKK<br>LLYIFKQPFMRPVQTTQEEDGCSCRFPEEEEGGCELRVKFSRSADAPA<br>YKQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQA<br>LPPR |

TABLE 8-continued

Amino Acid and Nucleic Acid Sequences of exemplary anti-BCMA scFv domains and BCMA CAR molecules

| Name/ Description | SEQ ID NO: | Sequence |
| --- | --- | --- |
| 139113- nt Full CAR | 188 | ATGGCCCTCCCTGTCACCGCCCTGCTGCTTCCGCTGGCTCTTCTGCTC CACGCCGCTCGGCCCGAAGTGCAATTGGTGGAAACTGGAGGAGGACTT GTGCAACCTGGAGGATCATTGCGGCTCTCATGCGCTGTCTCCGGCTTC GCCCTGTCAAATCACGGGATGTCGTGGGTCAGACGGGCCCCGGGAAAG GGTCTGGAATGGGTGTCGGGGATTGTGTACAGCGGCTCCACCTACTAC GCCGCTTCGGTCAAGGGCCGCTTCACTATTTCACGGGACAACAGCCGC AACACCCTCTATCTGCAAATGAACTCTCTCCGCCCGGAGGATACCGCC ATCTACTACTGCTCCGCACACGGCGGCGAATCCGACGTGTGGGGACAG GGAACCACTGTCACCGTGTCGTCCGCATCCGGTGGCGGAGGATCGGGT GGCCGGGCCTCCGGGGCGGCGGCAGCGAGACTACCCTGACCCAGTCC CCTGCCACTCTGTCCGTGAGCCCGGGAGAGAGAGCCACCCTTAGCTGC CGGGCCAGCCAGAGCGTGGGCTCCAACCTGGCCTGGTACCAGCAGAAG CCAGGACAGGGTCCCAGGCTGCTGATCTACGGAGCCTCCACTCGCGCG ACCGGCATCCCCGCGAGGTTCTCCGGGTCGGGTTCCGGGACCGAGTTC ACCCTGACCATCTCCTCCCTCCAACCGGAGGACTTCGCGGTGTACTAC TGTCAGCAGTACAACGATTGGCTGCCCGTGACATTTGGACAGGGGACG AAGGTGGAAATCAAAACCACTACCCCAGCACCGAGGCCACCCACCCCG GCTCCTACCATCGCCTCCCAGCCTCTGTCCCTGCGTCCGGAGGCATGT AGACCCGCAGCTGGTGGGGCCGTGCATACCCGGGGTCTTGACTTCGCC TGCGATATCTACATTTGGGCCCCTCTGGCTGGTACTTGCGGGGTCCTG CTGCTTTCACTCGTGATCACTCTTTACTGTAAGCGCGGTCGGAAGAAG CTGCTGTACATCTTTAAGCAACCCTTCATGAGGCCTGTGCAGACTACT CAAGAGGAGGACGGCTGTTCATGCCGGTTCCCAGAGGAGGAGGAAGGC GGCTGCGAACTGCGCGTGAAATTCAGCCGCAGCGCAGATGCTCCAGCC TACAAGCAGGGGCAGAACCAGCTCTACAACGAACTCAATCTTGGTCGG AGAGAGGAGTACGACGTGCTGGACAAGCGGAGAGGACGGGACCCAGAA ATGGGCGGGAAGCCGCGCAGAAAGAATCCCCAAGAGGGCCTGTACAAC GAGCTCCAAAAGGATAAGATGGCAGAAGCCTATAGCGAGATTGGTATG AAAGGGGAACGCAGAAGAGGCAAAGGCCACGACGGACTGTACCAGGGA CTCAGCACCGCCACCAAGGACACCTATGACGCTCTTCACATGCAGGCC CTGCCGCCTCGG |
| | 139114 | |
| 139114- aa ScFv domain | 189 | EVQLVESGGGLVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSSASGGGGSGGRASGGGGSEIVLTQSPGTLS LSPGERATLSCRASQSIGSSSLAWYQQKPGQAPRLLMYGASSRASGIP DRFSGSGSGTDFTLTISRLEPEDFAVYYCQQYAGSPPFTFGQGTKVEI K |
| 139114- nt ScFv domain | 190 | GAAGTGCAATTGGTGGAATCTGGTGGAGGACTTGTGCAACCTGGAGGA TCACTGAGACTGTCATGCGCGGTGTCCGGTTTTGCCCTGAGCAATCAT GGGATGTCGTGGGTCCGGCGCGCCCCCGGAAAGGGTCTGGAATGGGTG TCGGGTATCGTCTACTCCGGGAGCACTTACTACGCCGCGAGCGTGAAG GGCCGCTTCACCATTTCCCGCGATAACTCCCGCAACACCCTGTACTTG CAAATGAACTCGCTCCGGCCTGAGGACACTGCCATCTACTACTGCTCC GCACACGGAGGAGAATCCGACGTGTGGGGCCAGGGAACTACCGTGACC GTCAGCAGCGCCTCCGGCGGCGGGGGCTCAGGCGGACGGGCTAGCGGC GGCGGTGGCTCCGAGATCGTGCTGACCCAGTCGCCTGGCACTCTCTCG CTGAGCCCCGGGGAAAGGGCAACCCTGTCCTGTCGGGCCAGCCAGTCC ATTGGATCATCCTCCCTCGCCTGGTATCAGCAGAAACCGGGACAGGCT CCGCGGCTGCTTATGTATGGGGCCAGCTCAAGAGCCTCCGGCATTCCC GACCGGTTCTCCGGGTCCGGTTCCGGCACCGATTTCACCCTGACTATC TCGAGGCTGGAGCCAGAGGACTTCGCCGTGTACTACTGCCAGCAGTAC GCGGGGTCCCCGCCGTTCACGTTCGGACAGGGAACCAAGGTCGAGATC AAG |
| 139114- aa VH | 191 | EVQLVESGGGLVQPGGSLRLSCAVSGFALSNHGMSWVRRAPGKGLEWV SGIVYSGSTYYAASVKGRFTISRDNSRNTLYLQMNSLRPEDTAIYYCS AHGGESDVWGQGTTVTVSS |
| 139114- aa VL | 192 | EIVLTQSPGTLSLSPGERATLSCRASQSIGSSSLAWYQQKPGQAPRLL MYGASSRASGIPDRFSGSGSGTDFTLTISRLEPEDFAVYYCQQYAGSP PFTFGQGTKVEIK |
| 139114- aa Full CAR | 193 | MALPVTALLLPLALLLHAARPEVQLVESGGGLVQPGGSLRLSCAVSGF ALSNHGMSWVRRAPGKGLEWVSGIVYSGSTYYAASVKGRFTISRDNSR NTLYLQMNSLRPEDTAIYYCSAHGGESDVWGQGTTVTVSSASGGGGSG GRASGGGGSEIVLTQSPGTLSLSPGERATLSCRASQSIGSSSLAWYQQ KPGQAPRLLMYGASSRASGIPDRFSGSGSGTDFTLTISRLEPEDFAVY YCQQYAGSPPFTFGQGTKVEIKTTTPAPRPPTPAPTIASQPLSLRPEA |

TABLE 8-continued

Amino Acid and Nucleic Acid Sequences of exemplary anti-BCMA scFv domains and BCMA CAR molecules

| Name/<br>Description | SEQ<br>ID<br>NO: | Sequence |
|---|---|---|
|  |  | CRPAAGGAVHTRGLDFACDIYIWAPLAGTCGVLLLSLVITLYCKRGRK<br>KLLYIFKQPFMRPVQTTQEEDGCSCRFPEEEEGGCELRVKFSRSADAP<br>AYKQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQ<br>ALPPR |
| 139114- nt<br>Full CAR | 194 | ATGGCCCTCCCTGTCACCGCCCTGCTGCTTCCGCTGGCTCTTCTGCTC<br>CACGCCGCTCGGCCCGAAGTGCAATTGGTGGAATCTGGTGGAGGACTT<br>GTGCAACCTGGAGGATCACTGAGACTGTCATGCGCGGTGTCCGGTTTT<br>GCCCTGAGCAATCATGGGATGTCGTGGGTCCGGCGCGCCCCCGGAAAG<br>GGTCTGGAATGGGTGTCGGGTATCGTCTACTCCGGGAGCACTTACTAC<br>GCCGCGAGCGTGAAGGGCCGCTTCACCATTTCCCGCGATAACTCCCGC<br>AACACCCTGTACTTGCAAATGAACTCGCTCCGGCCTGAGGACACTGCC<br>ATCTACTACTGCTCCGCACACGGAGGAGAATCCGACGTGTGGGGCCAG<br>GGAACTACCGTGACCGTCAGCAGCGCCTCCGGCGGCGGGGGCTCAGGC<br>GGACGGGCTAGCGGCGGCGGTGGCTCCGAGATCGTGCTGACCCAGTCG<br>CCTGGCACTCTCTCGCTGAGCCCCGGGGAAAGGGCAACCCTGTCCTGT<br>CGGGCCAGCCAGTCCATTGGATCATCCTCCCTCGCCTGGTATCAGCAG<br>AAACCGGGACAGGCTCCGCGGCTGCTTATGTATGGGGCCAGCTCAAGA<br>GCCTCCGGCATTCCCGACCGGTTCTCGGGTCCGGTTCCGGCACCGAT<br>TTCACCCTGACTATCTCGAGGCTGGAGCCAGAGGACTTCGCCGTGTAC<br>TACTGCCAGCAGTACGGGGGTCCCCGCCGTTCACGTTCGGACAGGGA<br>ACCAAGGTCGAGATCAAGACCACTACCCCAGCACCGAGGCCACCCACC<br>CCGGCTCCTACCATCGCCTCCCAGCCTCTGTCCCTGCGTCCGGAGGCA<br>TGTAGACCCGCAGCTGGTGGGGCCGTGCATACCCGGGTCTTGACTTC<br>GCCTGCGATATCTACATTTGGGCCCCTCTGGCTGGTACTTGCGGGGTC<br>CTGCTGCTTTCACTCGTGATCACTCTTTACTGTAAGCGCGGTCGGAAG<br>AAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAA<br>GGCGGCTGCGAACTGCGCGTGAAATTCAGCCGCAGCGCAGATGCTCCA<br>GCCTACAAGCAGGGGCAGAACCAGCTCTACAACGAACTCAATCTTGGT<br>CGGAGAGAGGAGTACGACGTGCTGGACAAGCGGAGAGGACGGGACCCA<br>GAAATGGGCGGGAAGCCGCGCAGAAAGAATCCCCAAGAGGGCCTGTAC<br>AACGAGCTCCAAAAGGATAAGATGGCAGAAGCCTATAGCGAGATTGGT<br>ATGAAAGGGGAACGCAGAAGAGGCAAAGGCCACGACGGACTGTACCAG<br>GGACTCAGCACCGCCACCAAGGACACCTATGACGCTCTTCACATGCAG<br>GCCCTGCCGCCTCGG |

149362

| 149362-aa<br>ScFv<br>domain | 195 | QVQLQESGPGLVKPSETLSLTCTVSGGSISSSYYYWGWIRQPPGKGLE<br>WIGSIYYSGSAYYNPSLKSRVTISVDTSKNQFSLRLSSVTAADTAVYY<br>CARHWQEWPDAFDIWGQGTMVTVSSGGGGSGGGGSGGGGSETTLTQSP<br>AFMSATPGDKVIISCKASQDIDDAMNWYQQKPGEAPLFIIQSATSPVP<br>GIPPRFSGSGFGTDFSLTINNIESEDAAYYFCLQHDNFPLTFGQGTKL<br>EIK |
| 149362-nt<br>ScFv<br>domain | 196 | CAAGTGCAGCTTCAGGAAAGCGGACCGGGCCTGGTCAAGCCATCCGAA<br>ACTCTCTCCCTGACTTGCACTGTGTCTGGCGGTTCCATCTCATCGTCG<br>TACTACTACTGGGGCTGGATTAGGCAGCCGCCCGGAAAGGGACTGGAG<br>TGGATCGGAAGCATCTACTATTCCGGCTCGGCGTACTACAACCCTAGC<br>CTCAAGTCGAGAGTGACCATCTCCGTGGATACCTCCAAGAACCAGTTT<br>TCCCTGCGCCTGAGCTCCGTGACCGCCGCTGACACCGCCGTGTACTAC<br>TGTGCTCGGCATTGGCAGGAATGGCCCGATGCCTTCGACATTTGGGGC<br>CAGGGCACTATGGTCACTGTGTCATCCGGGGGTGGAGGCAGCGGGGGA<br>GGAGGGTCCGGGGGGGGAGGTTCAGAGACAACCTTGACCCAGTCACCC<br>GCATTCATGTCCGCCACTCCGGGAGACAAGGTCATCATCTCGTGCAAA<br>GCGTCCCAGGATATCGACGATGCCATGAATTGGTACCAGCAGAAGCCT<br>GGCGAAGCGCCGCTGTTCATTATCCAATCCGCAACCTCGCCCGTGCCT<br>GGAATCCCACCGCGGTTCAGCGGCAGCGGTTTCGGAACCGACTTTTCC<br>CTGACCATTAACAACATTGAGTCCGAGGACGCCGCCTACTACTTCTGC<br>CTGCAACACGACAACTTCCCTCTCACGTTCGGCCAGGGAACCAAGCTG<br>GAAATCAAG |
| 149362-aa<br>VH | 197 | QVQLQESGPGLVKPSETLSLTCTVSGGSISSSYYYWGWIRQPPGKGLE<br>WIGSIYYSGSAYYNPSLKSRVTISVDTSKNQFSLRLSSVTAADTAVYY<br>CARHWQEWPDAFDIWGQGTMVTVSS |
| 149362-aa<br>VL | 198 | ETTLTQSPAFMSATPGDKVIISCKASQDIDDAMNWYQQKPGEAPLFII<br>QSATSPVPGIPPRFSGSGFGTDFSLTINNIESEDAAYYFCLQHDNFPL<br>TFGQGTKLEIK |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| 149362-aa Full CAR | 199 | MALPVTALLLPLALLLHAARPQVQLQESGPGLVKPSETLSLTCTVSGG SISSSYYYWGWIRQPPGKGLEWIGSIYYSGSAYYNPSLKSRVTISVDT SKNQFSLRLSSVTAADTAVYYCARHWQEWPDAFDIWGQGTMVTVSSGG GGSGGGSGGGGSETTLTQSPAFMSATPGDKVIISCKASQDIDDAMNW YQQKPGEAPLFIIQSATSPVPGIPPRFSGSGFGTDFSLTINNIESEDA AYYFCLQHDNFPLTFGQGTKLEIKTTTPAPRPPTPAPTIASQPLSLRP EACRPAAGGAVHTRGLDFACDIYIWAPLAGTCGVLLLSLVITLYCKRG RKKLLYIFKQPFMRPVQTTQEEDGCSCRFPEEEEGGCELRVKFSRSAD APAYKQGQNQLYNELNLGRREEYDVLDKRRGRDPEMGGKPRRKNPQEG LYNELQKDKMAEAYSEIGMKGERRRGKGHDGLYQGLSTATKDTYDALH MQALPPR |
| 149362-nt Full CAR | 200 | ATGGCCCTCCCTGTCACCGCCCTGCTGCTTCCGCTGGCTCTTCTGCTC CACGCCGCTCGGCCCCAAGTGCAGCTTCAGGAAAGCGGACCGGGCCTG GTCAAGCCATCCGAAACTCTCTCCCTGACTTGCACTGTGTCTGGCGGT TCCATCTCATCGTCGTACTACTACTGGGGCTGGATTAGGCAGCCGCCC GGAAAGGGACTGGAGTGGATCGGAAGCATCTACTATTCCGGCTCGGCG TACTACAACCCTAGCCTCAAGTCGAGAGTGACCATCTCCGTGGATACC TCCAAGAACCAGTTTTCCCTGCGCCTGAGCTCCGTGACCGCCGCTGAC ACCGCCGTGTACTACTGTGCTCGGCATTGGCAGGAATGGCCCGATGCC TTCGACATTTGGGGCCAGGGCACTATGGTCACTGTGTCATCCGGGGGT GGAGGCAGCGGGGGAGGAGGGTCCGGGGGGGGAGGTTCAGAGACAACC TTGACCCAGTCACCCGCATTCATGTCCGCCACTCCGGGAGACAAGGTC ATCATCTCGTGCAAAGCGTCCCAGGATATCGACGATGCCATGAATTGG TACCAGCAGAAGCCTGGCGAAGCGCCGCTGTTCATTATCCAATCCGCA ACCTCGCCCGTGCCTGGAATCCCACCGCGGTTCAGCGGCAGCGGTTTC GGAACCGACTTTTCCCTGACCATTAACAACATTGAGTCCGAGGACGCC GCCTACTACTTCTGCCTGCAACACGACAACTTCCCTCTCACGTTCGGC CAGGGAACCAAGCTGGAAATCAAGACCACTACCCCAGCACCGAGGCCA CCCACCCCGGCTCCTACCATCGCCTCCCAGCCTCTGTCCCTGCGTCCG GAGGCATGTAGACCCGCAGCTGGTGGGCCGTGCATACCCGGGGTCTT GACTTCGCCTGCGATATCTACATTTGGGCCCCTCTGGCTGGTACTTGC GGGGTCCTGCTGCTTTCACTCGTGATCACTCTTTACTGTAAGCGCGGT CGGAAGAAGCTGCTGTACATCTTTAAGCAACCCTTCATGAGGCCTGTG CAGACTACTCAAGAGGAGGACGGCTGTTCATGCCGGTTCCCAGAGGAG GAGGAAGGCGGCTGCGAACTGCGCGTGAAATTCAGCCGCAGCGCAGAT GCTCCAGCCTACAAGCAGGGGCAGAACCAGCTCTACAACGAACTCAAT CTTGGTCGGAGAGAGGAGTACGACGTGCTGGACAAGCGGAGAGGACGG GACCCAGAAATGGGCGGGAAGCCGCGCAGAAAGAATCCCCAAGAGGGC CTGTACAACGAGCTCCAAAAGGATAAGATGGCAGAAGCCTATAGCGAG ATTGGTATGAAAGGGGAACGCAGAAGAGGCAAAGGCCACGACGGACTG TACCAGGGACTCAGCACCGCCACCAAGGACACCTATGACGCTCTTCAC ATGCAGGCCCTGCCGCCTCGG |

149363

| 149363-aa ScFv domain | 201 | VNLRESGPALVKPTQTLTLTCTFSGFSLRTSGMCVSWIRQPPGKALEW LARIDWDEDKFYSTSLKTRLTISKDTSDNQVVLRMTNMDPADTATYYC ARSGAGGTSATAFDIWGPGTMVTVSSGGGGSGGGGSGGGGSDIQMTQS PSSLSASVGDRVTITCRASQDIYNNLAWFQLKPGSAPRSLMYAANKSQ SGVPSRFSGSASGTDFTLTISSLQPEDFATYYCQHYYRFPYSFGQGTK LEIK |
| 149363-nt ScFv domain | 202 | CAAGTCAATCTGCGCGAATCCGGCCCCGCCTTGGTCAAGCCTACCCAG ACCCTCACTCTGACCTGTACTTTCTCCGGCTTCTCCCTGCGGACTTCC GGGATGTGCGTGTCCTGGATCAGACAGCCTCCGGGAAAGGCCCTGGAG TGGCTCGCTCGCATTGACTGGGATGAGGACAAGTTCTACTCCACCTCA CTCAAGACCAGGCTGACCATCAGCAAAGATACCTCTGACAACAAGTG GTGCTCCGCATGACCAACATGGACCCAGCCGACACTGCCACTTACTAC TGCGCGAGGAGCGGAGCGGGCGGAACCTCCGCCACCGCCTTCGATATT TGGGGCCCGGGTACCATGGTCACCGTGTCAAGCGGAGGAGGGGGTCC GGGGGCGGCGGTTCCGGGGGAGGCGGATCGGACATTCAGATGACTCAG TCACCATCGTCCCTGAGCGCTAGCGTGGGCGACAGAGTGACAATCACT TGCCGGGCATCCCAGGACATCTATAACAACCTTGCGTGGTTCCAGCTG AAGCCTGGTTCCGCACCGCGGTCACTTATGTACGCCGCCAACAAGAGC CAGTCGGGAGTGCCGTCCCGGTTTTCCGGTTCGGCCTCGGGAACTGAC TTCACCCTGACGATCTCCAGCCTGCAACCCGAGGATTTCGCCACCTAC TACTGCCAGCACTACTACCGCTTTCCCTACTCGTTCGGACAGGGAACC AAGCTGGAAATCAAG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| 149363-aa VH | 203 | QVNLRESGPALVKPTQTLTLTCTFSGFSLRTSGMCVSWIRQPPKALE WLARIDWDEDKFYSTSLKTRLTISKDTSDNQVVLRMTNMDPADTATYY CARSGAGGTSATAFDIWGPGTMVTVSS |
| 149363-aa VL | 204 | DIQMTQSPSSLSASVGDRVTITCRASQDIYNNLAWFQLKPGSAPRSLM YAANKSQSGVPSRFSGSASGTDFTLTISSLQPEDFATYYCQHYYRFPY SFGQGTKLEIK |
| 149363-aa Full CAR | 205 | MALPVTALLLPLALLLHAARPQVNLRESGPALVKPTQTLTLTCTFSGF SLRTSGMCVSWIRQPPGKALEWLARIDWDEDKFYSTSLKTRLTISKDT SDNQVVLRMTNMDPADTATYYCARSGAGGTSATAFDIWGPGTMVTVSS GGGGSGGGGSGGGGSDIQMTQSPSSLSASVGDRVTITCRASQDIYNNL AWFQLKPGSAPRSLMYAANKSQSGVPSRFSGSASGTDFTLTISSLQPE DFATYYCQHYYRFPYSFGQGTKLEIKTTTPAPRPPTPAPTIASQPLSL RPEACRPAAGGAVHTRGLDFACDIYIWAPLAGTCGVLLLSLVITLYCK RGRKKLLYIFKQPFMRPVQTTQEEDGCSCRFPEEEEGGCELRVKFSRS ADAPAYKQGQNQLYNELNLGRREEYDVLDKRRGRDPEMGGKPRRKNPQ EGLYNELQKDKMAEAYSEIGMKGERRRGKGHDGLYQGLSTATKDTYDA LHMQALPPR |
| 149363-nt Full CAR | 206 | ATGGCCCTCCCTGTCACCGCCCTGCTGCTTCCGCTGGCTCTTCTGCTC CACGCCGCTCGGCCCCAAGTCAATCTGCGCGAATCCGGCCCCGCCTTG GTCAAGCCTACCCAGACCCTCACTCTGACCTGTACTTTCTCCGGCTTC TCCCTGCGGACTTCCGGGATGTGCGTGTCCTGGATCAGACAGCCTCCG GGAAAGGCCCTGGAGTGGCTCGCTCGCATTGACTGGGATGAGGACAAG TTCTACTCCACCTCACTCAAGACCAGGCTGACCATCAGCAAAGATACC TCTGACAACCAAGTGGTGCTCCGCATGACCAACATGGACCCAGCCGAC ACTGCCACTTACTACTGCGCGAGGAGCGGAGCGGGCGGAACCTCCGCC ACCGCCTTCGATATTTGGGGCCCGGGTACCATGGTCACCGTGTCAAGC GGAGGAGGGGGTCCGGGGCGGCGGTTCCGGGGGAGGCGGATCGGAC ATTCAGATGACTCAGTCACCATCGTCCCTGAGCGCTAGCGTGGGCGAC AGAGTGACAATCACTTGCCGGGCATCCCAGGACATCTATAACAACCTT GCGTGGTTCCAGCTGAAGCCTGGTTCCGCACCGCGGTCACTTATGTAC GCCGCCAACAAGAGCCAGTCGGGAGTGCCGTCCCGGTTTTCCGGTTCG GCCTCGGGAACTGACTTCACCCTGACGATCTCCAGCCTGCAACCCGAG GATTTCGCCACCTACTACTGCCAGCACTACTACCGCTTTCCCTACTCG TTCGGACAGGGAACCAAGCTGGAAATCAAGACCACTACCCCAGCACCG AGGCCACCCACCCCGGCTCCTACCATCGCCTCCCAGCCTCTGTCCCTG CGTCCGGAGGCATGTAGACCCGCAGCTGGTGGGGCCGTGCATACCCGG GGTCTTGACTTCGCCTGCGATATCTACATTTGGGCCCCTCTGGCTGGT ACTTGCGGGGTCCTGCTGCTTTCACTCGTGATCACTCTTTACTGTAAG CGCGGTCGGAAGAAGCTGCTGTACATCTTTAAGCAACCCTTCATGAGG CCTGTGCAGACTACTCAAGAGGAGGACGGCTGTTCATGCCGGTTCCCA GAGGAGGAGGAAGGCGGCTGCGAACTGCGCGTGAAATTCAGCCGCAGC GCAGATGCTCCAGCCTACAAGCAGGGGCAGAACCAGCTCTACAACGAA CTCAATCTTGGTCGGAGAGAGGAGTACGACGTGCTGGACAAGCGGAGA GGACGGGACCCAGAAATGGGCGGGAAGCCGCGCAGAAAGAATCCCCAA GAGGGCCTGTACAACGAGCTCCAAAAGGATAAGATGGCAGAAGCCTAT AGCGAGATTGGTATGAAAGGGGAACGCAGAAGAGGCAAAGGCCACGAC GGACTGTACCAGGGACTCAGCACCGCCACCAAGGACACCTATGACGCT CTTCACATGCAGGCCCTGCCGCCTCGG |

149364

| 149364-aa ScFv domain | 207 | EVQLVESGGGLVKPGGSLRLSCAASGFTFSSYSMNWVRQAPGKGLEWV SSISSSSSYIYYADSVKGRFTISRDNAKNSLYLQMNSLRAEDTAVYYC AKTIAAVYAFDIWGQGTTVTVSSGGGGSGGGGSGGGGSEIVLTQSPLS LPVTPEEPASISCRSSQSLLHSNGYNYLDWYLQKPGQSPQLLIYLGSN RASGVPDRFSGSGSGTDFTLKISRVEAEDVGVYYCMQALQTPYTFGQG TKLEIK |
| 149364-nt ScFv domain | 208 | GAAGTGCAGCTTGTCGAATCCGGGGGGGGACTGGTCAAGCCGGGCGGA TCACTGAGACTGTCCTGCGCCGCGAGCGGCTTCACGTTCTCCTCCTAC TCCATGAACTGGGTCCGCCAAGCCCCCGGGAAGGGACTGGAATGGGTG TCCTCTATCTCCTCGTCGTCGTCCTACATCTACTACGCCGACTCCGTG AAGGGAAGATTCACCATTTCCCGCGACAACGCAAAGAACTCACTGTAC TTGCAAATGAACTCACTCCGGGCCGAAGATACTGCTGTACTATTGC GCCAAGACTATTGCCGCCGTCTACGCTTTCGACATCTGGGGCCAGGGA ACCACCGTGACTGTCGTCCGGTGGTGGTGGCTCGGCGGAGGAGGA AGCGGCGGCGGGGGTCCGAGATTGTGCTGACCCAGTCGCCACTGAGC CTCCCTGTGACCCCGAGGAACCCGCCAGCATCAGCTGCCGGTCCAGC CAGTCCCTGCTCCACTCCAACGGATACAATTACCTCGATTGGTACCTT |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | CAGAAGCCTGGACAAAGCCCGCAGCTGCTCATCTACTTGGGATCAAAC CGCGCGTCAGGAGTGCCTGACCGGTTCTCCGGCTCGGGCAGCGGTACC GATTCACCCTGAAAATCTCCAGGGTGGAGGCAGAGGACGTGGGAGTG TATTACTGTATGCAGGCGCTGCAGACTCCGTACACATTTGGGCAGGGC ACCAAGCTGGAGATCAAG |
| 149364-aa VH | 209 | EVQLVESGGGLVKPGGSLRLSCAASGFTFSSYSMNWVRQAPGKGLEWV SSISSSSSYIYYADSVKGRFTISRDNAKNSLYLQMNSLRAEDTAVYYC AKTIAAVYAFDIWGQGTTVTVSS |
| 149364-aa VL | 210 | EIVLTQSPLSLPVTPEEPASISCRSSQSLLHSNGYNYLDWYLQKPGQS PQLLIYLGSNRASGVPDRFSGSGSGTDFTLKISRVEAEDVGVYYCMQA LQTPYTFGQGTKLEIK |
| 149364-aa Full CAR | 211 | MALPVTALLLPLALLLHAARPEVQLVESGGGLVKPGGSLRLSCAASGF TFSSYSMNWVRQAPGKGLEWVSSISSSSSYIYYADSVKGRFTISRDNA KNSLYLQMNSLRAEDTAVYYCAKTIAAVYAFDIWGQGTTVTVSSGGGG SGGGGSGGGGSEIVLTQSPLSLPVTPEEPASISCRSSQSLLHSNGYNY LDWYLQKPGQSPQLLIYLGSNRASGVPDRFSGSGSGTDFTLKISRVEA EDVGVYYCMQALQTPYTFGQGTKLEIKTTTPAPRPPTPAPTIASQPLS LRPEACRPAAGGAVHTRGLDFACDIYIWAPLAGTCGVLLLSLVITLYC KRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNP QEGLYNELQKDKMAEAYSEIGMKGERRRGKGHDGLYQGLSTATKDTYD ALHMQALPPR |
| 149364-nt Full CAR | 212 | ATGGCCCTCCCTGTCACCGCCCTGCTGCTTCCGCTGGCTCTTCTGCTC CACGCCGCTCGGCCCGAAGTGCAGCTTGTCGAATCCGGGGGGGGACTG GTCAAGCCGGGCGGATCACTGAGACTGTCCTGCGCCGCGAGCGGCTTC ACGTTCTCCTCCTACTCCATGAACTGGGTCCGCCAAGCCCCCGGGAAG GGACTGGAATGGGTGTCCTCTATCTCCTCGTCGTCGTCCTACATCTAC TACGCCGACTCCGTGAAGGGAAGATTCACCATTTCCCGCGACAACGCA AAGAACTCACTGTACTTGCAAATGAACTCACTCCGGGCCGAAGATACT GCTGTGTACTATTGCGCCAAGACTATTGCCGCCGTCTACGCTTTCGAC ATCTGGGGCCAGGGAACCACCGTGACTGTGTCGTCCGGTGGTGGTGGC TCGGGCGGAGGAGGAAGCGGCGGCGGGGGGTCCGAGATTGTGCTGACC CAGTCGCCACTGAGCCTCCCTGTGACCCCCGAGGAACCCGCCAGCATC AGCTGCCGGTCCAGCCAGTCCCTGCTCCACTCCAACGGATACAATTAC CTCGATTGGTACCTTCAGAAGCCTGGACAAAGCCCGCAGCTGCTCATC TACTTGGGATCAAACCGCGCGTCAGGAGTGCCTGACCGGTTCTCCGGC TCGGGCAGCGGTACCGATTTCACCCTGAAAATCTCCAGGGTGGAGGCA GAGGACGTGGGAGTGTATTACTGTATGCAGGCGCTGCAGACTCCGTAC ACATTTGGGCAGGGCACCAAGCTGGAGATCAAGACCACTACCCCAGCA CCGAGGCCACCCACCCCGGCTCCTACCATCGCCTCCCAGCCTCTGTCC CTGCGTCCGGAGGCATGTAGACCCGCAGCTGGTGGGGCCGTGCATACC CGGGGTCTTGACTTCGCCTGCGATATCTACATTTGGGCCCCTCTGGCT GGTACTTGCGGGGTCCTGCTGCTTTCACTCGTGATCACTCTTTACTGT AAGCGCGGTCGGAAGAAGCTGCTGTACATCTTTAAGCAACCCTTCATG AGGCCTGTGCAGACTACTCAAGAGGAGGACGGCTGTTCATGCCGGTTC CCAGAGGAGGAGGAAGGCGGCTGCGAACTGCGCGTGAAATTCAGCCGC AGCGCAGATGCTCCAGCCTACAAGCAGGGGCAGAACCAGCTCTACAAC GAACTCAATCTTGGTCGGAGAGAGGAGTACGACGTGCTGGACAAGCGG AGAGGACGGGACCCAGAAATGGGCGGGAAGCCGCGCAGAAAGAATCCC CAAGAGGGCCTGTACAACGAGCTCCAAAAGGATAAGATGGCAGAAGCC TATAGCGAGATTGGTATGAAAGGGGAACGCAGAAGAGGCAAAGGCCAC GACGGACTGTACCAGGGACTCAGCACCGCCACCAAGGACACCTATGAC GCTCTTCACATGCAGGCCCTGCCGCCTCGG |

149365

| 149365-aa ScFv domain | 213 | EVQLVESGGGLVKPGGSLRLSCAASGFTFSDYYMSWIRQAPGKGLEWV SYISSSGSTIYYADSVKGRFTISRDNAKNSLYLQMNSLRAEDTAVYYC ARDLRGAFDIWGQGTMVTVSSGGGGSGGGGSGGGGSSYVLTQSPSVSA APGYTATISCGGNNIGTKSVHWYQQKPGQAPLLVIRDDSVRPSKIPGR FSGSNSGNMATLTISGVQAGDEADFYCQVWDSDSEHVVFGGGTKLTVL |
| 149365-nt ScFv domain | 214 | GAAGTCCAGCTCGTGGAGTCCGGCGGAGGCCTTGTGAAGCCTGGAGGT TCGCTGAGACTGTCCTGCGCCGCCTCCGGCTTCACCTTCTCCGACTAT TACATGTCCTGGATCAGACAGGCCCCGGGAAAGGGCCTGGAATGGGTG TCCTACATCTCGTCATCGGGCAGCACTATCTACTACGCGGACTCAGTG AAGGGGCGGTTCACCATTTCCCGGGATAACGCGAAGAACTCGCTGTAT CTGCAAATGAACTCACTGAGGGCCGAGGACACCGCCGTGTACTACTGC GCCCGCGATCTCCGCGGGGCATTTGACATCTGGGGACAGGGAACCATG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | GTCACAGTGTCCAGCGGAGGGGGAGGATCGGGTGGCGGAGGTTCCGGG GGTGGAGGCTCCTCCTACGTGCTGACTCAGAGCCCAAGCGTCAGCGCT GCGCCCGGTTACACGGCAACCATCTCCTGTGGCGGAAACAACATTGGG ACCAAGTCTGTGCACTGGTATCAGCAGAAGCCGGGCCAAGCTCCCCTG TTGGTGATCCGCGATGACTCCGTGCGGCCTAGCAAAATTCCGGGACGG TTCTCCGGCTCCAACAGCGGCAATATGGCCACTCTCACCATCTCGGGA GTGCAGGCCGGAGATGAAGCCGACTTCTACTGCCAAGTCTGGGACTCA GACTCCGAGCATGTGGTGTTCGGGGGCGGAACCAAGCTGACTGTGCTC |
| 149365-aa VH | 215 | EVQLVESGGGLVKPGGSLRLSCAASGFTFSDYYMSWIRQAPGKGLEWV SYISSSGSTIYYADSVKGRFTISRDNAKNSLYLQMNSLRAEDTAVYYC ARDLRGAFDIWGQGTMVTVSS |
| 149365-aa VL | 216 | SYVLTQSPSVSAAPGYTATISCGGNNIGTKSVHWYQQKPGQAPLLVIR DDSVRPSKIPGRFSGSNSGNMATLTISGVQAGDEADFYCQVWDSDSEH VVFGGGTKLTVL |
| 149365-aa Full CAR | 217 | MALPVTALLLPLALLLHAARPEVQLVESGGGLVKPGGSLRLSCAASGF TFSDYYMSWIRQAPGKGLEWVSYISSSGSTIYYADSVKGRFTISRDNA KNSLYLQMNSLRAEDTAVYYCARDLRGAFDIWGQGTMVTVSSGGGGSG GGGSGGGGSSYVLTQSPSVSAAPGYTATISCGGNNIGTKSVHWYQQKP GQAPLLVIRDDSVRPSKIPGRFSGSNSGNMATLTISGVQAGDEADFYC QVWDSDSEHVVFGGGTKLTVLTTTPAPRPPTPAPTIASQPLSLRPEAC RPAAGGAVHTRGLDFACDIYIWAPLAGTCGVLLLSLVITLYCKRGRKK LLYIFKQPFMRPVQTTQEEDGCSCRFPEEEEGGCELRVKFSRSADAPA YKQGQNQLYNELNLGRREEYDVLDKRRGRDPEMGGKPRRKNPQEGLYN ELQKDKMAEAYSEIGMKGERRRGKGHDGLYQGLSTATKDTYDALHMQA LPPR |
| 149365-nt Full CAR | 218 | ATGGCCCTCCCTGTCACCGCCCTGCTGCTTCCGCTGGCTCTTCTGCTC CACGCCGCTCGGCCCGAAGTCCAGCTCGTGGAGTCCGGCGGAGGCCTT GTGAAGCCTGGAGGTTCGCTGAGACTGTCCTGCGCCGCCTCCGGCTTC ACCTTCTCCGACTACTACATGTCCTGGATCAGACAGGCCCCCGGGAAG GGCCTGGAATGGGTGTCCTACATCTCGTCATCGGGCAGCACTATCTAC TACGCGGACTCAGTGAAGGGGCGGTTCACCATTTCCCGGGATAACGCG AAGAACTCGCTGTATCTGCAAATGAACTCACTGAGGGCCGAGGACACC GCCGTGTACTACTGCGCCCGCGATCTCCGCGGGGCATTTGACATCTGG GGACAGGGAACCATGGTCACAGTGTCCAGCGGAGGGGGAGGATCGGGT GGCGGAGGTTCCGGGGGTGGAGGCTCCTCCTACGTGCTGACTCAGAGC CCAAGCGTCAGCGCTGCGCCCGGTTACACGGCAACCATCTCCTGTGGC GGAAACAACATTGGGACCAAGTCTGTGCACTGGTATCAGCAGAAGCCG GGCCAAGCTCCCCTGTTGGTGATCCGCGATGACTCCGTGCGGCCTAGC AAAATTCCGGGACGGTTCTCCGGCTCCAACAGCGGCAATATGGCCACT CTCACCATCTCGGGAGTGCAGGCCGGAGATGAAGCCGACTTCTACTGC CAAGTCTGGGACTCAGACTCCGAGCATGTGGTGTTCGGGGGCGGAACC AAGCTGACTGTGCTCACCACTACCCCAGCACCGAGGCCACCCACCCCG GCTCCTACCATCGCCTCCCAGCCTCTGTCCCTGCGTCCGGAGGCATGT AGACCCGCAGCTGGTGGGGCCGTGCATACCCGGGTCTTGACTTCGCC TGCGATATCTACATTTGGGCCCCTCTGGCTGGTACTTGCGGGGTCCTG CTGCTTTCACTCGTGATCACTCTTTACTGTAAGCGCGGTCGGAAGAAG CTGCTGTACATCTTTAAGCAACCCTTCATGAGGCCTGTGCAGACTACT CAAGAGGAGGACGGCTGTTCATGCCGGTTCCCAGAGGAGGAGGAAGGC GGCTGCGAACTGCGCGTGAAATTCAGCCGCAGCGCAGATGCTCCAGCC TACAAGCAGGGGCAGAACCAGCTCTACAACGAACTCAATCTTGGTCGG AGAGAGGAGTACGACGTGCTGGACAAGCGAGAGGACGGGACCCAGAA ATGGGCGGGAAGCCGCGCAGAAAAGAATCCCCAAGAGGGCCTGTACAAC GAGCTCCAAAAGGATAAGATGGCAGAAGCCTATAGCGAGATTGGTATG AAAGGGGAACGCAGAAGAGGCAAAGGCCACGACGGACTGTACCAGGGA CTCAGCACCGCCACCAAGGACACCTATGACGCTCTTCACATGCAGGCC CTGCCGCCTCGG |

149366

| 149366-aa ScFv domain | 219 | QVQLVQSGAEVKKPGASVKVSCKPSGYTVTSHYIHWVRRAPGQGLEWM GMINPSGGVTAYSQTLQGRVTMTSDTSSSTVYMELSSLRSEDTAMYYC AREGSGSGWYFDFWGRGTLVTVSSGGGGSGGGGSGGGGSSYVLTQPPS VSVSPGQTASITCSGDGLSKKYVSWYQQKAGQSPVVLISRDKERPSGI PDRFSGSNSADTATLTISGTQAMDEADYYCQAWDDTTVVFGGGTKLTV L |
| 149366-nt ScFv domain | 220 | CAAGTGCAGCTGGTGCAGAGCGGGGCCGAAGTCAAGAAGCCGGGAGCC TCCGTGAAAGTGTCCTGCAAGCCTTCGGGATACACCGTGACCTCCCAC TACATTCATTGGGTCCGCCGCGCCCCCGGCCAAGGACTCGAGTGGATG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | GGCATGATCAACCCTAGCGGCGGAGTGACCGCGTACAGCCAGACGCTG CAGGGACGCGTGACTATGACCTCGGATACCTCCTCCTCCACCGTCTAT ATGGAACTGTCCAGCCTGCGGTCCGAGGATACCGCCATGTACTACTGC GCCCGGGAAGGATCAGGCTCCGGGTGGTATTTCGACTTCTGGGGAAGA GGCACCCTCGTGACTGTGTCATCTGGGGGAGGGGGTTCCGGTGGTGGC GGATCGGGAGGAGGCGGTTCATCCTACGTGCTGACCCAGCCACCCTCC GTGTCCGTGAGCCCCGGCCAGACTGCATCGATTACATGTAGCGGCGAC GGCCTCTCCAAGAAATACGTGTCGTGGTACCAGCAGAAGGCCGGACAG AGCCCGGTGGTGCTGATCTCAAGAGATAAGGAGCGGCCTAGCGGAATC CCGGACAGGTTCTCGGGTTCCAACTCCGCGGACACTGCTACTCTGACC ATCTCGGGGACCCAGGCTATGGACGAAGCCGATTACTACTGCCAAGCC TGGGACGACACTACTGTCGTGTTTGGAGGGGGCACCAAGTTGACCGTC CTT |
| 149366-aa VH | 221 | QVQLVQSGAEVKKPGASVKVSCKPSGYTVTSHYIHWVRRAPGQGLEWM GMINPSGGVTAYSQTLQGRVTMTSDTSSSTVYMELSSLRSEDTAMYYC AREGSGSGWYFDFWGRGTLVTVSS |
| 149366-aa VL | 222 | SYVLTQPPSVSVSPGQTASITCSGDGLSKKYVSWYQQKAGQSPVVLIS RDKERPSGIPDRFSGSNSADTATLTISGTQAMDEADYYCQAWDDTTVV FGGGTKLTVL |
| 149366-aa Full CAR | 223 | MALPVTALLLPLALLLHAARPQVQLVQSGAEVKKPGASVKVSCKPSGY TVTSHYIHWVRRAPGQGLEWMGMINPSGGVTAYSQTLQGRVTMTSDTS SSTVYMELSSLRSEDTAMYYCAREGSGSGWYFDFWGRGTLVTVSSGGG GSGGGGSGGGGSSYVLTQPPSVSVSPGQTASITCSGDGLSKKYVSWYQ QKAGQSPVVLISRDKERPSGIPDRFSGSNSADTATLTISGTQAMDEAD YYCQAWDDTTVVFGGGTKLTVLTTTPAPRPPTPAPTIASQPLSLRPEA CRPAAGGAVHTRGLDFACDIYIWAPLAGTCGVLLLSLVITLYCKRGRK KLLYIFKQPFMRPVQTTQEEDGCSCRFPEEEEGGCELRVKFSRSADAP AYKQGQNQLYNELNLGRREEYDVLDKRRGRDPEMGGKPRRKNPQEGLY NELQKDKMAEAYSEIGMKGERRRGKGHDGLYQGLSTATKDTYDALHMQ ALPPR |
| 149366-nt Full CAR | 224 | ATGGCCCTCCCTGTCACCGCCCTGCTGCTTCCGCTGGCTCTTCTGCTC CACGCCGCTCGGCCCCAAGTGCAGCTGGTGCAGAGCGGGGCCGAAGTC AAGAAGCCGGGAGCCTCCGTGAAAGTGTCCTGCAAGCCTTCGGGATAC ACCGTGACCTCCCACTACATTCATTGGGTCCGCCGCGCCCCCGGCCAA GGACTCGAGTGGATGGGCATGATCAACCCTAGCGGCGGAGTGACCGCG TACAGCCAGACGCTGCAGGGACGCGTGACTATGACCTCGGATACCTCC TCCTCCACCGTCTATATGGAACTGTCCAGCCTGCGGTCCGAGGATACC GCCATGTACTACTGCGCCCGGGAAGGATCAGGCTCCGGGTGGTATTTC GACTTCTGGGGAAGAGGCACCCTCGTGACTGTGTCATCTGGGGGAGGG GGTTCCGGTGGTGGCGGATCGGGAGGAGGCGGTTCATCCTACGTGCTG ACCCAGCCACCCTCCGTGTCCGTGAGCCCCGGCCAGACTGCATCGATT ACATGTAGCGGCGACGGCCTCTCCAAGAAATACGTGTCGTGGTACCAG CAGAAGGCCGGACAGAGCCCGGTGGTGCTGATCTCAAGAGATAAGGAG CGGCCTAGCGGAATCCCGGACAGGTTCTCGGGTTCCAACTCCGCGGAC ACTGCTACTCTGACCATCTCGGGGACCCAGGCTATGGACGAAGCCGAT TACTACTGCCAAGCCTGGGACGACACTACTGTCGTGTTTGGAGGGGGC ACCAAGTTGACCGTCCTTACCACTACCCCAGCACCGAGGCCACCCACC CCGGCTCCTACCATCGCCTCCCAGCCTCTGTCCCTGCGTCCGGAGGCA TGTAGACCCGCAGCTGGTGGGGCCGTGCATACCCGGGGTCTTGACTTC GCCTGCGATATCTACATTTGGGCCCCTCTGGCTGGTACTTGCGGGGTC CTGCTGCTTTCACTCGTGATCACTCTTTACTGTAAGCGCGGTCGGAAG AAGCTGCTGTACATCTTTAAGCAACCCTTCATGAGGCCTGTGCAGACT ACTCAAGAGGAGGACGGCTGTTCATGCCGGTTCCCAGAGGAGGAGGAA GGCGGCTGCGAACTGCGCGTGAAATTCAGCCGCAGCGCAGATGCTCCA GCCTACAAGCAGGGCCAGAACCAGCTCTACAACGAACTCAATCTTGGT CGGAGAGAGGAGTACGACGTGCTGGACAAGCGGAGAGGACGGGACCCA GAAATGGGCGGGAAGCCGCGCAGAAAGAATCCCAAGAGGGCCTGTAC AACGAGCTCCAAAAGGATAAGATGGCAGAAGCCTATAGCGAGATTGGT ATGAAAGGGGAACGCAGAAGAGGCAAAGGCCACGACGGACTGTACCAG GGACTCAGCACCGCCACCAAGGACACCTATGACGCTCTTCACATGCAG GCCCTGCCGCCTCGG |
| | | 149367 |
| 149367-aa ScFv domain | 225 | QVQLQESGPGLVKPSQTLSLTCTVSGGSISSGGYYWSWIRQHPGKGLE WIGYIYYSGSTYYNPSLKSRVTISVDTSKNQFSLKLSSVTAADTAVYY CARAGIAARLRGAFDIWGQGTMVTVSSGGGGSGGGGSGGGGSDIVMTQ |

TABLE 8-continued

Amino Acid and Nucleic Acid Sequences of exemplary anti-BCMA scFv domains and BCMA CAR molecules

| Name/ Description | SEQ ID NO: | Sequence |
| --- | --- | --- |
|  |  | SPSSVSASVGDRVIITCRASQGIRNWLAWYQQKPGKAPNLLIYAASNL QSGVPSRFSGSGSGADFTLTISSLQPEDVATYYCQKYNSAPFTFGPGT KVDIK |
| 149367-nt ScFv domain | 226 | CAAGTGCAGCTTCAGGAGAGCGGCCCGGGACTCGTGAAGCCGTCCCAG ACCCTGTCCCTGACTTGCACCGTGTCGGGAGGAAGCATCTCGAGCGGA GGCTACTATTGGTCGTGGATTCGGCAGCACCCTGGAAAGGGCCTGGAA TGGATCGGCTACATCTACTACTCCGGCTCGACCTACTACAACCCATCG CTGAAGTCCAGAGTGACAATCTCAGTGGACACGTCCAAGAATCAGTTC AGCCTGAAGCTCTCTTCCGTGACTGCGGCCGACACCGCCGTGTACTAC TGCGCACGCGCTGGAATTGCCGCCCGGCTGAGGGGTGCCTTCGACATT TGGGGACAGGGCACCATGGTCACCGTGTCCTCCGGCGGCGGAGGTTCC GGGGGTGGAGGCTCAGGAGGAGGGGGGTCCGACATCGTCATGACTCAG TCGCCCTCAAGCGTCAGCGCGTCCGTCGGGGACAGAGTGATCATCACC TGTCGGGCGTCCCAGGGAATTCGCAACTGGCTGGCCTGGTATCAGCAG AAGCCCGGAAAGGCCCCCAACCTGTTGATCTACGCCGCCTCAAACCTC CAATCCGGGGTGCCGAGCCGCTTCAGCGGCTCCGGTTCGGGTGCCGAT TTCACTCTGACCATCTCCTCCCTGCAACCTGAAGATGTGGCTACCTAC TACTGCCAAAAGTACAACTCCGCACCTTTTACTTTCGGACCGGGGACC AAAGTGGACATTAAG |
| 149367-aa VH | 227 | QVQLQESGPGLVKPSQTLSLTCTVSGGSISSGGYYWSWIRQHPGKGLE WIGYIYYSGSTYYNPSLKSRVTISVDTSKNQFSLKLSSVTAADTAVYY CARAGIAARLRGAFDIWGQGTMVTVSS |
| 149367-aa VL | 228 | DIVMTQSPSSVSASVGDRVIITCRASQGIRNWLAWYQQKPGKAPNLLI YAASNLQSGVPSRFSGSGSGADFTLTISSLQPEDVATYYCQKYNSAPF TFGPGTKVDIK |
| 149367-aa Full CAR | 229 | MALPVTALLLPLALLLHAARPQVQLQESGPGLVKPSQTLSLTCTVSGG SISSGGYYWSWIRQHPGKGLEWIGYIYYSGSTYYNPSLKSRVTISVDT SKNQFSLKLSSVTAADTAVYYCARAGIAARLRGAFDIWGQGTMVTVSS GGGGSGGGGSGGGGSDIVMTQSPSSVSASVGDRVIITCRASQGIRNWL AWYQQKPGKAPNLLIYAASNLQSGVPSRFSGSGSGADFTLTISSLQPE DVATYYCQKYNSAPFTFGPGTKVDIKTTTPAPRPPTPAPTIASQPLSL RPEACRPAAGGAVHTRGLDFACDIYIWAPLAGTCGVLLLSLVITLYCK RGRKKLLYIFKQPFMRPVQTTQEEDGCSCRFPEEEEGGCELRVKFSRS ADAPAYKQGQNQLYNELNLGRREEYDVLDKRRGRDPEMGGKPRRKNPQ EGLYNELQKDKMAEAYSEIGMKGERRRGKGHDGLYQGLSTATKDTYDA LHMQALPPR |
| 149367-nt Full CAR | 230 | ATGGCCCTCCCTGTCACCGCCCTGCTGCTTCCGCTGGCTCTTCTGCTC CACGCCGCTCGGCCCCAAGTGCAGCTTCAGGAGAGCGGCCCGGGACTC GTGAAGCCGTCCCAGACCCTGTCCCTGACTTGCACCGTGTCGGGAGGA AGCATCTCGAGCGGAGGCTACTATTGGTCGTGGATTCGGCAGCACCCT GGAAAGGGCCTGGAATGGATCGGCTACATCTACTACTCCGGCTCGACC TACTACAACCCATCGCTGAAGTCCAGAGTGACAATCTCAGTGGACACG TCCAAGAATCAGTTCAGCCTGAAGCTCTCTTCCGTGACTGCGGCCGAC ACCGCCGTGTACTACTGCGCACGCGCTGGAATTGCCGCCCGGCTGAGG GGTGCCTTCGACATTTGGGGACAGGGCACCATGGTCACCGTGTCCTCC GGCGGCGGAGGTTCCGGGGGTGGAGGCTCAGGAGGAGGGGGGTCCGAC ATCGTCATGACTCAGTCGCCCTCAAGCGTCAGCGCGTCCGTCGGGGAC AGAGTGATCATCACCTGTCGGGCGTCCCAGGGAATTCGCAACTGGCTG GCCTGGTATCAGCAGAAGCCCGGAAAGGCCCCCAACCTGTTGATCTAC GCCGCCTCAAACCTCCAATCCGGGGTGCCGAGCCGCTTCAGCGGCTCC GGTTCGGGTGCCGATTTCACTCTGACCATCTCCTCCCTGCAACCTGAA GATGTGGCTACCTACTACTGCCAAAAGTACAACTCCGCACCTTTTACT TTCGGACCGGGGACCAAAGTGGACATTAAGACCACTACCCCAGCACCG AGGCCACCCACCCCGGCTCCTACCATCGCCTCCCAGCCTCTGTCCCTG CGTCCGGAGGCATGTAGACCCGCAGCTGGTGGGCGTGCATACCCGG GGTCTTGACTTCGCCTGCGATATCTACATTTGGGCCCCTCTGGCTGGT ACTTGCGGGGTCCTGCTGCTTTCACTCGTGATCACTCTTTACTGTAAG CGCGGTCGGAAGAAGCTGCTGTACATCTTTAAGCAACCCTTCATGAGG CCTGTGCAGACTACTCAAGAGGAGGACGGCTGTTCATGCCGGTTCCCA GAGGAGGAGGAAGGCGGCTGCGAACTGCGCGTGAAATTCAGCCGCAGC GCAGATGCTCCAGCCTACAAGCAGGGGCAGAACCAGCTCTACAACGAA CTCAATCTTGGTCGGAGAGAGGAGTACGACGTGCTGGACAAGCGGAGA GGACGGGACCCAGAAATGGGCGGGAAGCCGCGCAGAAAGAATCCCCAA GAGGGCCTGTACAACGAGCTCCAAAAGGATAAGATGGCAGAAGCCTAT AGCGAGATTGGTATGAAGGGGAACGCAGAAGAGGCAAAGGCCACGAC GGACTGTACCAGGGACTCAGCACCGCCACCAAGGACACCTATGACGCT CTTCACATGCAGGCCCTGCCGCCTCGG |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | 149368 |
| 149368-aa ScFv domain | 231 | QVQLVQSGAEVKKPGSSVKVSCKASGGTFSSYAISWVRQAPGQGLEWM GGIIPIFGTANYAQKFQGRVTITADESTSTAYMELSSLRSEDTAVYYC ARRGGYQLLRWDVGLLRSAFDIWGQGTMVTVSSGGGGSGGGGSGGGGS SYVLTQPPSVSVAPGQTARITCGGNNIGSKSVHWYQQKPGQAPVLVLY GKNNRPSGVPDRFSGSRSGTTASLTITGAQAEDEADYYCSSRDSSGDH LRVFGTGTKVTVL |
| 149368-nt ScFv domain | 232 | CAAGTGCAGCTGGTCCAGTCGGGCGCCGAGGTCAAGAAGCCCGGGAGC TCTGTGAAAGTGTCCTGCAAGGCCTCCGGGGGCACCTTTAGCTCCTAC GCCATCTCCTGGGTCCGCCAAGCACCGGGTCAAGGCCTGGAGTGGATG GGGGGAATTATCCCTATCTTCGGCACTGCCAACTACGCCCAGAAGTTC CAGGGACGCGTGACCATTACCGCGGACGAATCCACCTCCACCGCTTAT ATGGAGCTGTCCAGCTTGCGCTCGGAAGATACCGCCGTGTACTACTGC GCCCGGAGGGGTGGATACCAGCTGCTGAGATGGGACGTGGGCCTCCTG CGGTCGGCGTTCGACATCTGGGGCCAGGGCACTATGGTCACTGTGTCC AGCGGAGGAGGCGGATCGGGAGGCGGCGGATCAGGGGGAGGCGGTTCC AGCTACGTGCTTACTCAACCCCCTTCGGTGTCCGTGGCCCCGGGACAG ACCGCCAGAATCACTTGCGGAGGAAACAACATTGGGTCCAAGAGCGTG CATTGGTACCAGCAGAAGCCAGGACAGGCCCCTGTGCTGGTGCTCTAC GGGAAGAACAATCGGCCCAGCGGAGTGCCGGACAGGTTCTCGGGTTCA CGCTCCGGTACAACCGCTTCACTGACTATCACCGGGGCCCAGGCAGAG GATGAAGCGGACTACTACTGTTCCTCCCGGGATTCATCCGGCGACCAC CTCCGGGTGTTCGGAACCGGAACGAAGGTCACCGTGCTG |
| 149368-aa VH | 233 | QVQLVQSGAEVKKPGSSVKVSCKASGGTFSSYAISWVRQAPGQGLEWM GGIIPIFGTANYAQKFQGRVTITADESTSTAYMELSSLRSEDTAVYYC ARRGGYQLLRWDVGLLRSAFDIWGQGTMVTVSS |
| 149368-aa VL | 234 | SYVLTQPPSVSVAPGQTARITCGGNNIGSKSVHWYQQKPGQAPVLVLY GKNNRPSGVPDRFSGSRSGTTASLTITGAQAEDEADYYCSSRDSSGDH LRVFGTGTKVTVL |
| 149368-aa Full CAR | 235 | MALPVTALLLPLALLLHAARPQVQLVQSGAEVKKPGSSVKVSCKASGG TFSSYAISWVRQAPGQGLEWMGGIIPIFGTANYAQKFQGRVTITADES TSTAYMELSSLRSEDTAVYYCARRGGYQLLRWDVGLLRSAFDIWGQGT MVTVSSGGGGSGGGGSGGGGSSYVLTQPPSVSVAPGQTARITCGGNNI GSKSVHWYQQKPGQAPVLVLYGKNNRPSGVPDRFSGSRSGTTASLTII GAQAEDEADYYCSSRDSSGDHLRVFGTGTKVTVLTTTPAPRPPTPAPT IASQPLSLRPEACRPAAGGAVHTRGLDFACDIYIWAPLAGTCGVLLLS LVITLYCKRGRKKLLYIFKQPFMRPVQTTQEEDGCSCRFPEEEEGGCE LRVKFSRSADAPAYKQGQNQLYNELNLGRREEYDVLDKRRGRDPEMGG KPRRKNPQEGLYNELQKDKMAEAYSEIGMKGERRRGKGHDGLYQGLST ATKDTYDALHMQALPPR |
| 149368-nt Full CAR | 236 | ATGGCCCTCCCTGTCACCGCCCTGCTGCTTCCGCTGGCTCTTCTGCTC CACGCCGCTCGGCCCCAAGTGCAGCTGGTCCAGTCGGGCGCCGAGGTC AAGAAGCCCGGGAGCTCTGTGAAAGTGTCCTGCAAGGCCTCCGGGGGC ACCTTTAGCTCCTACGCCATCTCCTGGGTCCGCCAAGCACCGGGTCAA GGCCTGGAGTGGATGGGGGGAATTATCCCTATCTTCGGCACTGCCAAC TACGCCCAGAAGTTCCAGGGACGCGTGACCATTACCGCGGACGAATCC ACCTCCACCGCTTATATGGAGCTGTCCAGCTTGCGCTCGGAAGATACC GCCGTGTACTACTGCGCCCGGAGGGGTGGATACCAGCTGCTGAGATGG GACGTGGGCCTCCTGCGGTCGGCGTTCGACATCTGGGGCCAGGGCACT ATGGTCACTGTGTCCAGCGGAGGAGGCGGATCGGGAGGCGGCGGATCA GGGGGAGGCGGTTCCAGCTACGTGCTTACTCAACCCCCTTCGGTGTCC GTGGCCCCGGGACAGACCGCCAGAATCACTTGCGGAGGAAACAACATT GGGTCCAAGAGCGTGCATTGGTACCAGCAGAAGCCAGGACAGGCCCCT GTGCTGGTGCTCTACGGGAAGAACAATCGGCCCAGCGGAGTGCCGGAC AGGTTCTCGGGTTCACGCTCCGGTACAACCGCTTCACTGACTATCACC GGGGCCCAGGCAGAGGATGAAGCGGACTACTACTGTTCCTCCCGGGAT TCATCCGGCGACCACCTCCGGGTGTTCGGAACCGGAACGAAGGTCACC GTGCTGACCACTACCCCAGCACCGAGGCCACCCACCCCGGCTCCTACC ATCGCCTCCCAGCCTCTGTCCCTGCGCTCCGGAGGCATGTAGACCCGCA GCTGGTGGGCCGTGCATACCCGGGTCTTGACTTCGCCTGCGATATC TACATTTGGGCCCCTCTGGCTGGTACTTGCGGGGTCCTGCTGCTTTCA CTCGTGATCACTCTTTACTGTAAGCGCGGTCGGAAGAAGCTGCTGTAC ATCTTTAAGCAACCCTTCATGAGGCCTGTGCAGACTACTCAAGAGGAG GACGGCTGTTCATGCCGGTTCCCAGAGGAGGAGGAAGGCGGCTGCGAA CTGCGCGTGAAATTCAGCCGCAGCGCAGATGCTCCAGCCTACAAGCAG GGGCAGAACCAGCTCTACAACGAACTCAATCTTGGTCGGAGAGAGGAG TACGACGTGCTGGACAAGCGGAGAGGACGGGACCCAGAAATGGGCGGG TABLE 8-continued Amino Acid and Nucleic Acid Sequences of exemplary anti-BCMA scFv domains and BCMA CAR molecules

| Name/ Description | SEQ ID NO: | Sequence |
|---|---|---|
| | | AAGCCGCGCAGAAAGAATCCCCAAGAGGGCCTGTACAACGAGCTCCAA AAGGATAAGATGGCAGAAGCCTATAGCGAGATTGGTATGAAAGGGGAA CGCAGAAGAGGCAAAGGCCACGACGGACTGTACCAGGGACTCAGCACC GCCACCAAGGACACCTATGACGCTCTTCACATGCAGGCCCTGCCGCCT CGG |
| | | 149369 |
| 149369-aa ScFv domain | 237 | EVQLQQSGPGLVKPSQTLSLTCAISGDSVSSNSAAWNWIRQSPSRGLE WLGRTYYRSKWYSFYAISLKSRIIINPDTSKNQFSLQLKSVTPEDTAV YYCARSSPEGLFLYWFDPWGQGTLVTVSSGGDGSGGGGSGGGGSSSEL TQDPAVSVALGQTIRITCQGDSLGNYYATWYQQKPGQAPVLVIYGTNN RPSGIPDRFSASSSGNTASLTITGAQAEDEADYYCNSRDSSGHHLLFG TGTKVTVL |
| 149369-nt ScFv domain | 238 | GAAGTGCAGCTCCAACAGTCAGGACCGGGGCTCGTGAAGCCATCCCAG ACCCTGTCCCTGACTTGTGCCATCTCGGGAGATAGCGTGTCATCGAAC TCCGCCGCCTGGAACTGGATTCGGCAGAGCCCGTCCCGCGGACTGGAG TGGCTTGGAAGGACCTACTACCGGTCCAAGTGGTACTCTTTCTACGCG ATCTCGCTGAAGTCCCGCATTATCATTAACCCTGATACCTCCAAGAAT CAGTTCTCCCTCCAACTGAAATCCGTCACCCCCGAGGACACAGCAGTG TATTACTGCGCACGGAGCAGCCCCGAAGGACTGTTCCTGTATTGGTTT GACCCCTGGGGCCAGGGGACTCTTGTGACCGTGTCGAGCGGCGGAGAT GGGTCCGGTGGCGGTGGTTCGGGGGGCGGCGGATCATCATCCGAACTG ACCCAGGACCCGGCTGTGTCCGTGGCGCTGGGACAAACCATCCGCATT ACGTGCCAGGGAGACTCCCTGGGCAACTACTACGCCACTTGGTACCAG CAGAAGCCGGGCCAAGCCCCTGTGTTGGTCATCTACGGGACCAACAAC AGACCTTCCGGCATCCCCGACCGGTTCAGCGCTTCGTCCTCCGGCAAC ACTGCCAGCCTGACCATCACTGGAGCGCAGGCCGAAGATGAGGCCGAC TACTACTGCAACAGCAGAGACTCCTCGGGTCATCACCTCTTGTTCGGA ACTGGAACCAAGGTCACCGTGCTG |
| 149369-aa VH | 239 | EVQLQQSGPGLVKPSQTLSLTCAISGDSVSSNSAAWNWIRQSPSRGLE WLGRTYYRSKWYSFYAISLKSRIIINPDTSKNQFSLQLKSVTPEDTAV YYCARSSPEGLFLYWFDPWGQGTLVTVSS |
| 149369-aa VL | 240 | SSELTQDPAVSVALGQTIRITCQGDSLGNYYATWYQQKPGQAPVLVIY GTNNRPSGIPDRFSASSSGNTASLTITGAQAEDEADYYCNSRDSSGHH LLFGTGTKVTVL |
| 149369-aa Full CAR | 241 | MALPVTALLLPLALLLHAARPEVQLQQSGPGLVKPSQTLSLTCAISGD SVSSNSAAWNWIRQSPSRGLEWLGRTYYRSKWYSFYAISLKSRIIINP DTSKNQFSLQLKSVTPEDTAVYYCARSSPEGLFLYWFDPWGQGTLVTV SSGGDGSGGGGSGGGGSSSELTQDPAVSVALGQTIRITCQGDSLGNYY ATWYQQKPGQAPVLVIYGTNNRPSGIPDRFSASSSGNTASLTITGAQA EDEADYYCNSRDSSGHHLLFGTGTKVTVLTTTPAPRPPTPAPTIASQP LSLRPEACRPAAGGAVHTRGLDFACDIYIWAPLAGTCGVLLLSLVITL YCKRGRKKLLYIFKQPFMRPVQTTQEEDGCSCRFPEEEEGGCELRVKF SRSADAPAYKQGQNQLYNELNLGRREEYDVLDKRRGRDPEMGGKPRRK NPQEGLYNELQKDKMAEAYSEIGMKGERRRGKGHDGLYQGLSTATKDT YDALHMQALPPR |
| 149369-nt Full CAR | 242 | ATGGCCCTCCCTGTCACCGCCCTGCTGCTTCCGCTGGCTCTTCTGCTC CACGCCGCTCGGCCCGAAGTGCAGCTCCAACAGTCAGGACCGGGGCTC GTGAAGCCATCCCAGACCCTGTCCCTGACTTGTGCCATCTCGGGAGAT AGCGTGTCATCGAACTCCGCCGCCTGGAACTGGATTCGGCAGAGCCCG TCCCGCGGACTGGAGTGGCTTGGAAGGACCTACTACCGGTCCAAGTGG TACTCTTTCTACGCGATCTCGCTGAAGTCCCGCATTATCATTAACCCT GATACCTCCAAGAATCAGTTCTCCCTCCAACTGAAATCCGTCACCCCC GAGGACACAGCAGTGTATTACTGCGCACGGAGCAGCCCCGAAGGACTG TTCCTGTATTGGTTTGACCCCTGGGGCCAGGGGACTCTTGTGACCGTG TCGAGCGGCGGAGATGGGTCCGGTGGCGGTGGTTCGGGGGGCGGCGGA TCATCATCCGAACTGACCCAGGACCCGGCTGTGTCCGTGGCGCTGGGA CAAACCATCCGCATTACGTGCCAGGGAGACTCCCTGGGCAACTACTAC GCCACTTGGTACCAGCAGAAGCCGGGCCAAGCCCCTGTGTTGGTCATC TACGGGACCAACAACAGACCTTCCGGCATCCCCGACCGGTTCAGCGCT TCGTCCTCCGGCAACACTGCCAGCCTGACCATCACTGGAGCGCAGGCC GAAGATGAGGCCGACTACTACTGCAACAGCAGAGACTCCTCGGGTCAT CACCTCTTGTTCGGAACTGGAACCAAGGTCACCGTGCTGACCACTACC CCAGCACCGAGGCCACCCACCCCGGCTCCTACCATCGCCTCCCAGCCT CTGTCCCTGCGTCCGGAGGCATGTAGACCCGCAGCTGGTGGGGCCGTG CATACCCGGGGTCTTGACTTCGCCTGCGATATCTACATTTGGGCCCCT CTGGCTGGTACTTGCGGGGTCCTGCTGCTTTCACTCGTGATCACTCTT |

TABLE 8-continued

Amino Acid and Nucleic Acid Sequences of exemplary anti-BCMA scFv domains and BCMA CAR molecules

| Name/<br>Description | SEQ<br>ID<br>NO: | Sequence |
|---|---|---|
| | | TACTGTAAGCGCGGTCGGAAGAAGCTGCTGTACATCTTTAAGCAACCC<br>TTCATGAGGCCTGTGCAGACTACTCAAGAGGAGGACGGCTGTTCATGC<br>CGGTTCCCAGAGGAGGAGGAAGGCGGCTGCGAACTGCGCGTGAAATTC<br>AGCCGCAGCGCAGATGCTCCAGCCTACAAGCAGGGGCAGAACCAGCTC<br>TACAACGAACTCAATCTTGGTCGGAGAGAGGAGTACGACGTGCTGGAC<br>AAGCGGAGAGGACGGGACCCAGAAATGGGCGGGAAGCCGCGCAGAAAG<br>AATCCCCAAGAGGGCCTGTACAACGAGCTCCAAAAGGATAAGATGGCA<br>GAAGCCTATAGCGAGATTGGTATGAAAGGGGAACGCAGAAGAGGCAAA<br>GGCCACGACGGACTGTACCAGGGACTCAGCACCGCCACCAAGGACACC<br>TATGACGCTCTTCACATGCAGGCCCTGCCGCCTCGG |

BCMA_EBB-C1978-A4

| BCMA_EBB-<br>C1978-A4-<br>aa<br>ScFv<br>domain | 243 | EVQLVESGGGLVQPGGSLRLSCAASGFTFSSYAMSWVRQAPGKGLEWV<br>SAISGSGGSTYYADSVKGRFTISRDNSKNTLYLQMNSLRAEDTAVYYC<br>AKVEGSGSLDYWGQGTLVTVSSGGGGSGGGGSGGGGSEIVMTQSPGTL<br>SLSPGERATLSCRASQSVSSAYLAWYQQKPGQPPRLLISGASTRATGI<br>PDRFGGSGSGTDFTLTISRLEPEDFAVYYCQHYGSSFNGSSLFTFGQG<br>TRLEIK |
| BCMA_EBB-<br>C1978-A4-<br>nt<br>ScFv<br>domain | 244 | GAAGTGCAGCTCGTGGAGTCAGGAGGCGGCCTGGTCCAGCCGGGAGGG<br>TCCCTTAGACTGTCATGCGCCGCAAGCGGATTCACTTTCTCCTCCTAT<br>GCCATGAGCTGGGTCCGCCAAGCCCCCGGAAAGGGACTGGAATGGGTG<br>TCCGCCATCTCGGGGTCTGGAGGCTCAACTTACTACGCTGACTCCGTG<br>AAGGGACGGTTCACCATTAGCCGCGACAACTCCAAGAACACCCTCTAC<br>CTCCAAATGAACTCCCTGCGGGCCGAGGATACCGCCGTCTACTACTGC<br>GCCAAAGTGGAAGGTTCAGGATCGCTGGACTACTGGGGACAGGGTACT<br>CTCGTGACCGTGTCATCGGGCGGAGGAGGTTCCGGCGGTGGCGGCTCC<br>GGCGGCGGAGGGTCGGAGATCGTGATGACCCAGAGCCCTGGTACTCTG<br>AGCCTTTCGCCGGGAGAAAGGGCCACCCTGTCCTGCCGCGCTTCCCAA<br>TCCGTGTCCTCCGCGTACTTGGCGTGGTACCAGCAGAAGCCGGGACAG<br>CCCCCTCGGCTGCTGATCAGCGGGGCCAGCACCCGGGCAACCGGAATC<br>CCAGACAGATTCGGGGGTTCCGGCAGCGGCACAGATTTCACCCTGACT<br>ATTTCGAGGTTGGAGCCCGAGGACTTTGCGGTGTATTACTGTCAGCAC<br>TACGGGTCGTCCTTTAATGGCTCCAGCCTGTTCACGTTCGGACAGGGG<br>ACCCGCCTGGAAATCAAG |
| BCMA_EBB-<br>C1978-A4-<br>aa<br>VH | 245 | EVQLVESGGGLVQPGGSLRLSCAASGFTFSSYAMSWVRQAPGKGLEWV<br>SAISGSGGSTYYADSVKGRFTISRDNSKNTLYLQMNSLRAEDTAVYYC<br>AKVEGSGSLDYWGQGTLVTVSS |
| BCMA_EBB-<br>C1978-A4-<br>aa<br>VL | 246 | EIVMTQSPGTLSLSPGERATLSCRASQSVSSAYLAWYQQKPGQPPRLL<br>ISGASTRATGIPDRFGGSGSGTDFTLTISRLEPEDFAVYYCQHYGSSF<br>NGSSLFTFGQGTRLEIK |
| BCMA_EBB-<br>C1978-A4-<br>aa<br>Full CART | 247 | MALPVTALLLPLALLLHAARPEVQLVESGGGLVQPGGSLRLSCAASGF<br>TFSSYAMSWVRQAPGKGLEWVSAISGSGGSTYYADSVKGRFTISRDNS<br>KNTLYLQMNSLRAEDTAVYYCAKVEGSGSLDYWGQGTLVTVSSGGGGS<br>GGGGSGGGGSEIVMTQSPGTLSLSPGERATLSCRASQSVSSAYLAWYQ<br>QKPGQPPRLLISGASTRATGIPDRFGGSGSGTDFTLTISRLEPEDFAV<br>YYCQHYGSSFNGSSLFTFGQGTRLEIKTTTPAPRPPTPAPTIASQPLS<br>LRPEACRPAAGGAVHTRGLDFACDIYIWAPLAGTCGVLLLSLVITLYC<br>KRGRKKLLYIFKQPFMRPVQTTQEEDGCSCRFPEEEEGGCELRVKFSR<br>SADAPAYKQGQNQLYNELNLGRREEYDVLDKRRGRDPEMGGKPRRKNP<br>QEGLYNELQKDKMAEAYSEIGMKGERRRGKGHDGLYQGLSTATKDTYD<br>ALHMQALPPR |
| BCMA_EBB-<br>C1978-A4-<br>nt<br>Full CART | 248 | ATGGCCCTCCCTGTCACCGCCCTGCTGCTTCCGCTGGCTCTTCTGCTC<br>CACGCCGCTCGGCCCGAAGTGCAGCTCGTGGAGTCAGGAGGCGGCCTG<br>GTCCAGCCGGGAGGGTCCCTTAGACTGTCATGCGCCGCAAGCGGATTC<br>ACTTTCTCCTCCTATGCCATGAGCTGGGTCCGCCAAGCCCCCGGAAAG<br>GGACTGGAATGGGTGTCCGCCATCTCGGGGTCTGGAGGCTCAACTTAC<br>TACGCTGACTCCGTGAAGGGACGGTTCACCATTAGCCGCGACAACTCC<br>AAGAACACCCTCTACCTCCAAATGAACTCCCTGCGGGCCGAGGATACC<br>GCCGTCTACTACTGCGCCAAAGTGGAAGGTTCAGGATCGCTGGACTAC<br>TGGGGACAGGGTACTCTCGTGACCGTGTCATCGGGCGGAGGAGGTTCC<br>GGCGGTGGCGGCTCCGGCGGCGGAGGGTCGGAGATCGTGATGACCCAG<br>AGCCCTGGTACTCTGAGCCTTTCGCCGGGAGAAAGGGCCACCCTGTCC<br>TGCCGCGCTTCCCAATCCGTGTCCTCCGCGTACTTGGCGTGGTACCAG<br>CAGAAGCCGGGACAGCCCCCTCGGCTGCTGATCAGCGGGGCCAGCACC<br>CGGGCAACCGGAATCCCAGACAGATTCGGGGGTTCCGGCAGCGGCACA |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | GATTTCACCCTGACTATTTCGAGGTTGGAGCCCGAGGACTTTGCGGTG TATTACTGTCAGCACTACGGGTCGTCCTTTAATGGCTCCAGCCTGTTC ACGTTCGGACAGGGGACCCGCCTGGAAATCAAGACCACTACCCCAGCA CCGAGGCCACCCACCCCGGCTCCTACCATCGCCTCCCAGCCTCTGTCC CTGCGTCCGGAGGCATGTAGACCCGCAGCTGGTGGGGCCGTGCATACC CGGGGTCTTGACTTCGCCTGCGATATCTACATTTGGGCCCCTCTGGCT GGTACTTGCGGGGTCCTGCTGCTTTCACTCGTGATCACTCTTTACTGT AAGCGCGGTCGGAAGAAGCTGCTGTACATCTTTAAGCAACCCTTCATG AGGCCTGTGCAGACTACTCAAGAGGAGGACGGCTGTTCATGCCGGTTC CCAGAGGAGGAGGAAGGCGGCTGCGAACTGCGCGTGAAATTCAGCCGC AGCGCAGATGCTCCAGCCTACAAGCAGGGGCAGAACCAGCTCTACAAC GAACTCAATCTTGGTCGGAGAGAGGAGTACGACGTGCTGGACAAGCGG AGAGGACGGGACCCAGAAATGGGCGGGAAGCCGCGCAGAAAGAATCCC CAAGAGGGCCTGTACAACGAGCTCCAAAAGGATAAGATGGCAGAAGCC TATAGCGAGATTGGTATGAAAGGGGAACGCAGAAGAGGCAAAGGCCAC GACGGACTGTACCAGGGACTCAGCACCGCCACCAAGGACACCTATGAC GCTCTTCACATGCAGGCCCTGCCGCCTCGG |
| | | BCMA_EBB-C1978-G1 |
| BCMA_EBB-C1978-G1-aa ScFv domain | 249 | EVQLVETGGGLVQPGGSLRLSCAASGITFSRYPMSWVRQAPGKG LEWVSGISDSGVSTYYADSAKGRFTISRDNSKNTLFLQMSSLRDE DTAVYYCVTRAGSEASDIWGQGTMVTVSSGGGGSGGGGSGGG GSEIVLTQSPATLSLSPGERATLSCRASQSVSNSLAWYQQKPGQA PRLLIYDASSRATGIPDRFSGSGSGTDFTLTISRLEPEDFAIYYCQQ FGTSSGLTFGGGTKLEIK |
| BCMA_EBB-C1978-G1-nt ScFv domain | 250 | GAAGTGCAACTGGTGGAAACCGGTGGCGGCCTGGTGCAGCCTGGAGGA TCATTGAGGCTGTCATGCGCGGCCAGCGGTATTACCTTCTCCCGGTAC CCCATGTCCTGGGTCAGACAGGCCCCGGGGAAAGGGCTTGAATGGGTG TCCGGGATCTCGGACTCCGGTGTCAGCACTTACTACGCCGACTCCGCC AAGGGACGCTTCACCATTTCCCGGGACAACTCGAAGAACACCCTGTTC CTCCAAATGAGCTCCCTCCGGGACGAGGATACTGCAGTGTACTACTGC GTGACCCGCGCCGGGTCCGAGGCGTCTGACATTTGGGGACAGGGCACT ATGGTCACCGTGTCGTCCGGCGGAGGGGGCTCGGGAGGCGGTGGCAGC GGAGGAGGAGGGTCCGAGATCGTGCTGACCCAATCCCCGGCCACCCTC TCGCTGAGCCCTGGAGAAAGGGCAACCTTGTCCTGTCGCGCGAGCCAG TCCGTGAGCAACTCCCTGGCCTGGTACCAGCAGAAGCCCGGACAGGCT CCGAGACTTCTGATCTACGACGCTTCGAGCCGGGCCACTGGAATCCCC GACCGCTTTTCGGGGTCCGGCTCAGGAACCGATTTCACCCTGACAATC TCACGGCTGGAGCCAGAGGATTTCGCCATCTATTACTGCCAGCAGTTC GGTACTTCCTCCGGCCTGACTTTCGGAGGCGGCACGAAGCTCGAAATC AAG |
| BCMA_EBB-C1978-G1-aa VH | 251 | EVQLVETGGGLVQPGGSLRLSCAASGITFSRYPMSWVRQAPGKGLEWV SGISDSGVSTYYADSAKGRFTISRDNSKNTLFLQMSSLRDEDTAVYYC VTRAGSEASDIWGQGTMVTVSS |
| BCMA_EBB-C1978-G1-aa VL | 252 | EIVLTQSPATLSLSPGERATLSCRASQSVSNSLAWYQQKPGQAPRLLI YDASSRATGIPDRFSGSGSGTDFTLTISRLEPEDFAIYYCQQFGTSSG LTFGGGTKLEIK |
| BCMA_EBB-C1978-G1-aa Full CART | 253 | MALPVTALLLPLALLLHAARPEVQLVETGGGLVQPGGSLRLSCAASGI TFSRYPMSWVRQAPGKGLEWVSGISDSGVSTYYADSAKGRFTISRDNS KNTLFLQMSSLRDEDTAVYYCVTRAGSEASDIWGQGTMVTVSSGGGGS GGGGSGGGGSEIVLTQSPATLSLSPGERATLSCRASQSVSNSLAWYQQ KPGQAPRLLIYDASSRATGIPDRFSGSGSGTDFTLTISRLEPEDFAIY YCQQFGTSSGLTFGGGTKLEIKTTTPAPRPPTPAPTIASQPLSLRPEA CRPAAGGAVHTRGLDFACDIYIWAPLAGTCGVLLLSLVITLYCKRGRK KLLYIFKQPFMRPVQTTQEEDGCSCRFPEEEEGGCELRVKFSRSADAP AYKQGQNQLYNELNLGRREEYDVLDKRRGRDPEMGGKPRRKNPQEGLY NELQKDKMAEAYSEIGMKGERRRGKGHDGLYQGLSTATKDTYDALHMQ ALPPR |
| BCMA_EBB-C1978-G1-nt Full CART | 254 | ATGGCCCTCCCTGTCACCGCCCTGCTGCTTCCGCTGGCTCTTCTGCTC CACGCCGCTCGGCCCGAAGTGCAACTGGTGGAAACCGGTGGCGGCCTG GTGCAGCCTGGAGGATCATTGAGGCTGTCATGCGCGGCCAGCGGTATT ACCTTCTCCCGGTACCCCATGTCCTGGGTCAGACAGGCCCCGGGGAAA GGGCTTGAATGGGTGTCCGGGATCTCGGACTCCGGTGTCAGCACTTAC TACGCCGACTCCGCCAAGGGACGCTTCACCATTTCCCGGGACAACTCG AAGAACACCCTGTTCCTCCAAATGAGCTCCCTCCGGGACGAGGATACT |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | GCAGTGTACTACTGCGTGACCCGCGCCGGGTCCGAGGCGTCTGACATT TGGGGACAGGGCACTATGGTCACCGTGTCGTCCGGCGGAGGGGGCTCG GGAGGCGGTGGCAGCGGAGGAGGAGGGTCCGAGATCGTGCTGACCCAA TCCCCGGCCACCCTCTCGCTGAGCCCTGGAGAAAGGGCAACCTTGTCC TGTCGCGCGAGCCAGTCCGTGAGCAACTCCCTGGCCTGGTACCAGCAG AAGCCCGGACAGGCTCCGAGACTTCTGATCTACGACGCTTCGAGCCGG GCCACTGGAATCCCCGACCGCTTTTCGGGGTCCGGCTCAGGAACCGAT TTCACCCTGACAATCTCACGGCTGGAGCCAGAGGATTTCGCCATCTAT TACTGCCAGCAGTTCGGTACTTCCTCCGGCCTGACTTTCGGAGGCGGC ACGAAGCTCGAAATCAAGACCACTACCCCAGCACCGAGGCCACCCACC CCGGCTCCTACCATCGCCTCCCAGCCTCTGTCCCTGCGTCCGGAGGCA TGTAGACCCGCAGCTGGTGGGGCCGTGCATACCCGGGGTCTTGACTTC GCCTGCGATATCTACATTTGGGCCCCTCTGGCTGGTACTTGCGGGGTC CTGCTGCTTTCACTCGTGATCACTCTTTACTGTAAGCGCGGTCGGAAG AAGCTGCTGTACATCTTTAAGCAACCCTTCATGAGGCCTGTGCAGACT ACTCAAGAGGAGGACGGCTGTTCATGCCGGTTCCCAGAGGAGGAGGAA GGCGGCTGCGAACTGCGCGTGAAATTCAGCCGCAGCGCAGATGCTCCA GCCTACAAGCAGGGGCAGAACCAGCTCTACAACGAACTCAATCTTGGT CGGAGAGAGGAGTACGACGTGCTGGACAAGCGGAGAGGACGGGACCCA GAAATGGGCGGGAAGCCGCGCAGAAAGAATCCCCAAGAGGGCCTGTAC AACGAGCTCCAAAAGGATAAGATGGCAGAAGCCTATAGCGAGATTGGT ATGAAAGGGGAACGCGAGAAGAGGCAAAGGCCACGACGGACTGTACCAG GGACTCAGCACCGCCACCAAGGACACCTATGACGCTCTTCACATGCAG GCCCTGCCGCCTCGG |

BCMA_EBB-C1979-C1

| BCMA_EBB-C1979-C1-aa ScFv domain | 255 | QVQLVESGGGLVQPGGSLRLSCAASGFTFSSYAMSWVRQAPGKGLEWV SAISGSGGSTYYADSVKGRFTISRDNAKNSLYLQMNSLRAEDTAIYYC ARATYKRELRYYYGMDVWGQGTMVTVSSGGGGSGGGGSGGGGSEIVMT QSPGTVSLSPGERATLSCRASQSVSSSFLAWYQQKPGQAPRLLIYGAS SRATGIPDRFSGSGSGTDFTLTISRLEPEDSAVYYCQQYHSSPSWTFG QGTRLEIK |
| BCMA_EBB-C1979-C1-nt ScFv domain | 256 | CAAGTGCAGCTCGTGGAATCGGGTGGCGGACTGGTGCAGCCGGGGGGC TCACTTAGACTGTCCTGCGCGGCCAGCGGATTCACTTTCTCCTCCTAC GCCATGTCCTGGGTCAGACAGGCCCCTGGAAAGGGCCTGGAATGGGTG TCCGCAATCAGCGGCAGCGGCGGCTCGACCTATTACGCGGATTCAGTG AAGGGCAGATTCACCATTTCCCGGGACAACGCCAAGAACTCCTTGTAC CTTCAAATGAACTCCCTCCGCGCGGAAGATACCGCAATCTACTACTGC GCTCGGGCCACTTACAAGAGGGAACTGCGCTACTACTACGGGATGGAC GTCTGGGGCCAGGGAACCATGGTCACCGTGTCCAGCGGAGGAGGAGGA TCGGGAGGAGGCGGTAGCGGGGGTGGAGGGTCGGAGATCGTGATGACC CAGTCCCCCGGCACTGTGTCGCTGTCCCCGGCGAACGGGCCACCCTG TCATGTCGGGCCAGCCAGTCAGTGTCGTCAAGCTTCCTCGCCTGGTAC CAGCAGAAACCGGGACAAGCTCCCCGCCTGCTGATCTACGGAGCCAGC AGCCGGGCCACCGGTATTCCTGACCGGTTCTCCGGTTCGGGGTCCGGG ACCGACTTTACTCTGACTATCTCTCGCCTCGAGCCAGAGGACTCCGCC GTGTATTACTGCCAGCAGTACCACTCCTCCCCGTCCTGGACGTTCGGA CAGGGCACAAGGCTGGAGATTAAG |
| BCMA_EBB-C1979-C1-aa VH | 257 | QVQLVESGGGLVQPGGSLRLSCAASGFTFSSYAMSWVRQAPGKGLEWV SAISGSGGSTYYADSVKGRFTISRDNAKNSLYLQMNSLRAEDTAIYYC ARATYKRELRYYYGMDVWGQGTMVTVSS |
| BCMA_EBB-C1979-C1-aa VL | 258 | EIVMTQSPGTVSLSPGERATLSCRASQSVSSSFLAWYQQKPGQAPRLL IYGASSRATGIPDRFSGSGSGTDFTLTISRLEPEDSAVYYCQQYHSSP SWTFGQGTRLEIK |
| BCMA_EBB-C1979-C1-aa Full CART | 259 | MALPVTALLLPLALLLHAARPQVQLVESGGGLVQPGGSLRLSCAASGF TFSSYAMSWVRQAPGKGLEWVSAISGSGGSTYYADSVKGRFTISRDNA KNSLYLQMNSLRAEDTAIYYCARATYKRELRYYYGMDVWGQGTMVTVS SGGGGSGGGGSGGGGSEIVMTQSPGTVSLSPGERATLSCRASQSVSSS FLAWYQQKPGQAPRLLIYGASSRATGIPDRFSGSGSGTDFTLTISRLE PEDSAVYYCQQYHSSPSWTFGQGTRLEIKTTTPAPRPPTPAPTIASQP LSLRPEACRPAAGGAVHTRGLDFACDIYIWAPLAGTCGVLLLSLVITL YCKRGRKKLLYIFKQPFMRPVQTTQEEDGCSCRFPEEEEGGCELRVKF SRSADAPAYKQGQNQLYNELNLGRREEYDVLDKRRGRDPEMGGKPRRK NPQEGLYNELQKDKMAEAYSEIGMKGERRRGKGHDGLYQGLSTATKDT YDALHMQALPPR |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| BCMA_EBB-C1979-C1-nt Full CART | 260 | ATGGCCCTCCCTGTCACCGCCCTGCTGCTTCCGCTGGCTCTTCTGCTC CACGCCGCTCGGCCCCAAGTGCAGCTCGTGGAATCGGGTGGCGGACTG GTGCAGCCGGGGGGCTCACTTAGACTGTCCTGCGCGGCCAGCGGATTC ACTTTCTCCTCCTACGCCATGTCCTGGGTCAGACAGGCCCCTGGAAAG GGCCTGGAATGGGTGTCCGCAATCAGCGGCAGCGGCGGCTCGACCTAT TACGCGGATTCAGTGAAGGGCAGATTCACCATTTCCCGGGACAACGCC AAGAACTCCTTGTACCTTCAAATGAACTCCCTCCGCGCGGAAGATACC GCAATCTACTACTGCGCTCGGGCCACTTACAAGAGGGAACTGCGCTAC TACTACGGGATGGACGTCTGGGGCCAGGGAACCATGGTCACCGTGTCC AGCGGAGGAGGAGGATCGGGAGGAGGCGGTAGCGGGGGTGGAGGGTCG GAGATCGTGATGACCCAGTCCCCCGGCACTGTGTCGCTGTCCCCCGGC GAACGGGCCACCCTGTCATGTCGGGCCAGCCAGTCAGTGTCGTCAAGC TTCCTCGCCTGGTACCAGCAGAAACCGGGACAAGCTCCCCGCCTGCTG ATCTACGGAGCCAGCAGCCGGGCCACCGGTATTCCTGACCGGTTCTCC GGTTCGGGGTCCGGGACCGACTTTACTCTGACTATCTCTCGCCTCGAG CCAGAGGACTCCGCCGTGTATTACTGCCAGCAGTACCACTCCTCCCCG TCCTGGACGTTCGGACAGGGCACAAGGCTGGAGATTAAGACCACTACC CCAGCACCGAGGCCACCCACCCCGGCTCCTACCATCGCCTCCCAGCCT CTGTCCCTGCGCTCCGGAGGCATGTAGACCCGCAGCTGGTGGGGCCGTG CATACCCGGGGTCTTGACTTCGCCTGCGATATCTACATTTGGGCCCCT CTGGCTGGTACTTGCGGGGTCCTGCTGCTTTCACTCGTGATCACTCTT TACTGTAAGCGCGGTCGGAAGAAGCTGCTGTACATCTTTAAGCAACCC TTCATGAGGCCTGTGCAGACTACTCAAGAGGAGGACGGCTGTTCATGC CGGTTCCCAGAGGAGGAGGAAGGCGGCTGCGAACTGCGCGTGAAATTC AGCCGCAGCGCAGATGCTCCAGCCTACAAGCAGGGGCAGAACCAGCTC TACAACGAACTCAATCTTGGTCGGAGAGAGGAGTACGACGTGCTGGAC AAGCGGAGAGGACGGGACCCAGAAATGGGCGGGAAGCCGCGCAGAAAG AATCCCCAAGAGGGCCTGTACAACGAGCTCCAAAAGGATAAGATGGCA GAAGCCTATAGCGAGATTGGTATGAAAGGGGAACGCAGAAGAGGCAAA GGCCACGACGGACTGTACCAGGGACTCAGCACCGCCACCAAGGACACC TATGACGCTCTTCACATGCAGGCCCTGCCGCCTCGG |
| BCMA_EBB-C1978-C7 | | |
| BCMA_EBB-C1978-C7-aa ScFv domain | 261 | EVQLVETGGGLVQPGGSLRLSCAASGFTFSSYAMSWVRQAPGKGLEWV SAISGSGGSTYYADSVKGRFTISRDNSKNTLYLQMNTLKAEDTAVYYC ARATYKRELRYYYGMDVWGQGTTVTVSSGGGGSGGGGSGGGGSEIVLT QSPSTLSLSPGESATLSCRASQSVSTTFLAWYQQKPGQAPRLLIYGSS NRATGIPDRFSGSGSGTDFTLTIRRLEPEDFAVYYCQQYHSSPSWTFG QGTKVEIK |
| BCMA_EBB-C1978-C7-nt ScFv domain | 262 | GAGGTGCAGCTTGTGGAAACCGGTGGCGGACTGGTGCAGCCCGGAGGA AGCCTCAGGCTGTCCTGCGCCGCGTCCGGCTTCACCTTCTCCTCGTAC GCCATGTCCTGGGTCCGCCAGGCCCCCGGAAAGGGCCTGGAATGGGTG TCCGCCATCTCTGGAAGCGGAGGTTCCACGTACTACGCGGACAGCGTC AAGGGAAGGTTCACAATCTCCCGCGATAATTCGAAGAACACTCTGTAC CTTCAAATGAACACCCTGAAGGCCGAGGACACTGTGTGTACTACTGC GCACGGGCCACCTACAAGAGAGAGCTCCGGTACTACTACGGAATGGAC GTCTGGGGCCAGGGAACTACTGTGACCGTGTCCTCGGGAGGGGTGGC TCCGGGGGGCGGCTCCGGCGGAGGCGGTTCCGAGATTGTGCTGACC CAGTCACCCTTCAACTCTGTCGCTGTCCCCGGGAGAGAGCGCTACTCTG AGCTGCCGGGCCAGCCAGTCCGTGTCCACCACCTTCCTCGCCTGGTAT CAGCAGAAGCCGGGCAGGCACCACGGCTCTTGATCTACGGGTCAAGC AACAGAGCGACCGGAATTCCTGACCGCTTCTCGGGGAGCGGTTCAGGC ACCGACTTCACCCTGACTATCCGGCGCCTGGAACCCGAAGATTTCGCC GTGTATTACTGTCAACAGTACCACTCCTCGCCGTCCTGGACCTTTGGC CAAGGAACCAAAGTGGAAATCAAG |
| BCMA_EBB-C1978-C7-aa VH | 263 | EVQLVETGGGLVQPGGSLRLSCAASGFTFSSYAMSWVRQAPGKGLEWV SAISGSGGSTYYADSVKGRFTISRDNSKNTLYLQMNTLKAEDTAVYYC ARATYKRELRYYYGMDVWGQGTTVTVSS |
| BCMA_EBB-C1978-C7-aa VL | 264 | EIVLTQSPSTLSLSPGESATLSCRASQSVSTTFLAWYQQKPGQAPRLL IYGSSNRATGIPDRFSGSGSGTDFTLTIRRLEPEDFAVYYCQQYHSSP SWTFGQGTKVEIK |
| BCMA_EBB-C1978-C7-aa Full CART | 265 | MALPVTALLLPLALLLHAARPEVQLVETGGGLVQPGGSLRLSCAASGF TFSSYAMSWVRQAPGKGLEWVSAISGSGGSTYYADSVKGRFTISRDNS KNTLYLQMNTLKAEDTAVYYCARATYKRELRYYYGMDVWGQGTTVTVS SGGGGSGGGGSGGGGSEIVLTQSPSTLSLSPGESATLSCRASQSVSTT FLAWYQQKPGQAPRLLIYGSSNRATGIPDRFSGSGSGTDFTLTIRRLE |

TABLE 8-continued

Amino Acid and Nucleic Acid Sequences of exemplary anti-BCMA scFv domains and BCMA CAR molecules

| Name/<br>Description | SEQ<br>ID<br>NO: | Sequence |
|---|---|---|
| | | PEDFAVYYCQQYHSSPSWTFGQGTKVEIKTTTPAPRPPTPAPTIASQP<br>LSLRPEACRPAAGGAVHTRGLDFACDIYIWAPLAGTCGVLLLSLVITL<br>YCKRGRKKLLYIFKQPFMRPVQTTQEEDGCSCRFPEEEEGGCELRVKF<br>SRSADAPAYKQGQNQLYNELNLGRREEYDVLDKRRGRDPEMGGKPRRK<br>NPQEGLYNELQKDKMAEAYSEIGMKGERRRGKGHDGLYQGLSTATKDT<br>YDALHMQALPPR |
| BCMA_EBB-<br>C1978-C7-<br>nt<br>Full CART | 266 | ATGGCCCTCCCTGTCACCGCCCTGCTGCTTCCGCTGGCTCTTCTGCTC<br>CACGCCGCTCGGCCCGAGGTGCAGCTTGTGGAAACCGGTGGCGGACTG<br>GTGCAGCCCGGAGGAAGCCTCAGGCTGTCCTGCGCCGTCGCTTC<br>ACCTTCTCCTCGTACGCCATGTCCTGGGTCCGCCAGGCCCCCGGAAAG<br>GGCCTGGAATGGGTGTCCGCCATCTCTGGAAGCGGAGGTTCCACGTAC<br>TACGCGGACAGCGTCAAGGGAAGGTTCACAATCTCCCGCGATAATTCG<br>AAGAACACTCTGTACCTTCAAATGAACACCCTGAAGGCCGAGGACACT<br>GCTGTGTACTACTGCGCACGGGCCACCTACAAGAGAGAGCTCCGGTAC<br>TACTACGGAATGGACGTCTGGGGCCAGGGAACTACTGTGACCGTGTCC<br>TCGGGAGGGGGTGGCTCCGGGGGGGGCGGCTCCGGCGGAGGCGGTTCC<br>GAGATTGTGCTGACCCAGTCACCTTCAACTCTGTCGCTGTCCCCGGGA<br>GAGAGCGCTACTCTGAGCTGCCGGGCCAGCCAGTCCGTGTCCACCACC<br>TTCCTCGCCTGGTATCAGCAGAAGCCGGGCAGGCACCACGGCTCTTG<br>ATCTACGGGTCAAGCAACAGAGCGACCGGAATTCCTGACCGCTTCTCG<br>GGGAGCGGTTCAGGCACCGACTTCACCCTGACTATCCGGCGCCTGGAA<br>CCCGAAGATTTCGCCGTGTATTACTGTCAACAGTACCACTCCTCGCCG<br>TCCTGGACCTTTGGCCAAGGAACCAAAGTGGAAATCAAGACCACTACC<br>CCAGCACCGAGGCCACCCACCCCGGCTCCTACCATCGCCTCCCAGCCT<br>CTGTCCCTGCGTCCGGAGGCATGTAGACCCGCAGCTGGTGGGCCGTG<br>CATACCCGGGGTCTTGACTTCGCCTGCGATATCTACATTTGGGCCCCT<br>CTGGCTGGTACTTGCGGGGTCCTGCTGCTTTCACTCGTGATCACTCTT<br>TACTGTAAGCGCGGTCGGAAGAAGCTGCTGTACATCTTTAAGCAACCC<br>TTCATGAGGCCTGTGCAGACTACTCAAGAGGAGGACGGCTGTTCATGC<br>CGGTTCCCAGAGGAGGAGGAAGGCGGCTGCGAACTGCGCGTGAAATTC<br>AGCCGCAGCGCAGATGCTCCAGCCTACAAGCAGGGGCAGAACCAGCTC<br>TACAACGAACTCAATCTTGGTCGGAGAGAGGAGTACGACGTGCTGGAC<br>AAGCGGAGAGGACGGGACCCAGAAATGGGCGGGAAGCCGCGCAGAAAG<br>AATCCCCAAGAGGGCCTGTACAACGAGCTCCAAAAGGATAAGATGGCA<br>GAAGCCTATAGCGAGATTGGTATGAAAGGGGAACGCAGAAGAGGCAAA<br>GGCCACGACGGACTGTACCAGGGACTCAGCACCGCCACCAAGGACACC<br>TATGACGCTCTTCACATGCAGGCCCTGCCGCCTCGG |

BCMA_EBB-C1978-D10

| BCMA_EBB-<br>C1978-<br>D10 - aa<br>ScFv<br>domain | 267 | EVQLVETGGGLVQPGRSLRLSCAASGFTFDDYAMHWVRQAPGKGLEWV<br>SGISWNSGSIGYADSVKGRFTISRDNAKNSLYLQMNSLRDEDTAVYYC<br>ARVGKAVPDVWGQGTTVTVSSGGGGSGGGGSGGGGSDIVMTQTPSSLS<br>ASVGDRVTITCRASQSISSYLNWYQQKPGKAPKLLIYAASSLQSGVPS<br>RFSGSGSGTDFTLTISSLQPEDFATYYCQQSYSTPYSFGQGTRLEIK |
| BCMA_EBB-<br>C1978-<br>D10- nt<br>ScFv<br>domain | 268 | GAAGTGCAGCTCGTGGAAACTGGAGGTGGACTCGTGCAGCCTGGACGG<br>TCGCTGCGGCTGAGCTGCGCTGCATCCGGCTTCACCTTCGACGATTAT<br>GCCATGCACTGGGTCAGACAGGCGCCAGGGAAGGGACTTGAGTGGGTG<br>TCCGGTATCAGCTGGAATAGCGGCTCAATCGGATACGCGGACTCCGTG<br>AAGGGAAGGTTCACCATTTCCCGCGACAACGCCAAGAACTCCCTGTAC<br>TTGCAAATGAACAGCCTCCGGGATGAGGACACTGCCGTGTACTACTGC<br>GCCCGCGTCGGAAAAGCTGTGCCCGACGTCTGGGGCCAGGGAACCACT<br>GTGACCGTGTCCAGCGGCGGGGGTGGATCGGGCGGTGGAGGGTCCGGT<br>GGAGGGGGCTCAGATATTGTGATGACCCAGACCCCCTCGTCCCTGTCC<br>GCCTCGGTCGGCGACCGCGTGACTATCACATGTAGAGCCTCGCAGAGC<br>ATCTCCAGCTACCTGAACTGGTATCAGCAGAAGCCGGGGAAGGCCCCG<br>AAGCTCCTGATCTACGCGGCATCATCACTGCAATGGGAGTGCCGAGC<br>CGGTTTTCCGGGTCCGGCTCCGGCACCGACTTCACGCTGACCATTTCT<br>TCCCTGCAACCCGAGGACTTCGCCACTTACTACTGCCAGCAGTCCTAC<br>TCCACCCCTTACTCCTTCGGCCAAGGAACCAGGCTGGAAATCAAG |
| BCMA_EBB-<br>C1978-<br>D10 - aa<br>VH | 269 | EVQLVETGGGLVQPGRSLRLSCAASGFTFDDYAMHWVRQAPGKGLEWV<br>SGISWNSGSIGYADSVKGRFTISRDNAKNSLYLQMNSLRDEDTAVYYC<br>ARVGKAVPDVWGQGTTVTVSS |
| BCMA_EBB-<br>C1978-<br>D10- aa<br>VL | 270 | DIVMTQTPSSLSASVGDRVTITCRASQSISSYLNWYQQKPGKAPKLLI<br>YAASSLQSGVPSRFSGSGSGTDFTLTISSLQPEDFATYYCQQSYSTPY<br>SFGQGTRLEIK |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| BCMA_EBB-C1978-D10 - aa Full CART | 271 | MALPVTALLLPLALLLHAARPEVQLVETGGGLVQPGRSLRLSCAASGF TFDDYAMHWVRQAPGKGLEWVSGISWNSGSIGYADSVKGRFTISRDNA KNSLYLQMNSLRDEDTAVYYCARVGKAVPDVWGQGTTVTVSSGGGGSG GGGSGGGGSDIVMTQTPSSLSASVGDRVTITCRASQSISSYLNWYQQK PGKAPKLLIYAASSLQSGVPSRFSGSGSGTDFTLTISSLQPEDFATYY CQQSYSTPYSFGQGTRLEIKTTTPAPRPPTPAPTIASQPLSLRPEACR PAAGGAVHTRGLDFACDIYIWAPLAGTCGVLLLSLVITLYCKRGRKKL LYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNE LQKDKMAEAYSEIGMKGERRRGKGHDGLYQGLSTATKDTYDALHMQAL PPR |
| BCMA_EBB-C1978-D10 - nt Full CART | 272 | ATGGCCCTCCCTGTCACCGCCCTGCTGCTTCCGCTGGCTCTTCTGCTC CACGCCGCTCGGCCCGAAGTGCAGCTCGTGGAAACTGGAGGTGGACTC GTGCAGCCTGGACGGTCGCTGCGGCTGAGCTGCGCTGCATCCGGCTTC ACCTTCGACGATTATGCCATGCACTGGGTCAGACAGGCGCCAGGGAAG GGACTTGAGTGGGTGTCCGGTATCAGCTGGAATAGCGGCTCAATCGGA TACGCGGACTCCGTGAAGGGAAGGTTCACCATTTCCCGCGACAACGCC AAGAACTCCCTGTACTTGCAAATGAACAGCCTCCGGGATGAGGACACT GCCGTGTACTACTGCGCCCGCGTCGGAAAAGCTGTGCCCGACGTCTGG GGCCAGGGAACCACTGTGACCGTGTCCAGCGGCGGGGGTGGATCGGGC GGTGGAGGGTCCGGTGGAGGGGGCTCAGATATTGTGATGACCCAGACC CCCTCGTCCCTGTCCGCCTCGGTCGGCGACCGCGTGACTATCACATGT AGAGCCTCGCAGAGCATCTCCAGCTACCTGAACTGGTATCAGCAGAAG CCGGGGAAGGCCCCGAAGCTCCTGATCTACGCGGCATCATCACTGCAA TCGGGAGTGCCGAGCCGGTTTTCCGGGTCCGGCTCCGGCACCGACTTC ACGCTGACCATTTCTTCCCTGCAACCCGAGGACTTCGCCACTTACTAC TGCCAGCAGTCCTACTCCACCCCTTACTCCTTCGGCCAAGGAACCAGG CTGGAAATCAAGACCACTACCCCAGCACCGAGGCCACCCACCCCGGCT CCTACCATCGCCTCCCAGCCTCTGTCCCTGCGTCCGGAGGCATGTAGA CCCGCAGCTGGTGGGGCCGTGCATACCCGGGGTCTTGACTTCGCCTGC GATATCTACATTTGGGCCCCTCTGGCTGGTACTTGCGGGGTCCTGCTG CTTTCACTCGTGATCACTCTTTACTGTAAGCGCGGTCGGAAGAAGCTG CTGTACATCTTTAAGCAACCCTTCATGAGGCCTGTGCAGACTACTCAA GAGGAGGACGGCTGTTCATGCCGGTTCCCAGAGGAGGAGGAAGGCGGC TGCGAACTGCGCGTGAAATTCAGCCGCAGCGCAGATGCTCCAGCCTAC AAGCAGGGGCAGAACCAGCTCTACAACGAACTCAATCTTGGTCGGAGA GAGGAGTACGACGTGCTGGACAAGCGGAGAGGACGGGACCCAGAAATG GGCGGGAAGCCGCGCAGAAAGAATCCCCAAGAGGGCCTGTACAACGAG CTCCAAAAGGATAAGATGGCAGAAGCCTATAGCGAGATTGGTATGAAA GGGGAACGCAGAAGAGGCAAAGGCCACGACGGACTGTACCAGGGACTC AGCACCGCCACCAAGGACACCTATGACGCTCTTCACATGCAGGCCCTG CCGCCTCGG |

BCMA_EBB-C1979-C12

| BCMA_EBB-C1979-C12- aa ScFv domain | 273 | EVQLVESGGGLVQPGRSLRLSCTASGFTFDDYAMHWVRQRPGKGLEWV ASINWKGNSLAYGDSVKGRFAISRDNAKNTVFLQMNSLRTEDTAVYYC ASHQGVAYYNYAMDVWGRGTLVTVSSGGGGSGGGGSGGGGSEIVLTQS PGTLSLSPGERATLSCRATQSIGSSFLAWYQQRPGQAPRLLIYGASQR ATGIPDRFSGRGSGTDFTLTISRVEPEDSAVYYCQHYESSPSWTFGQG TKVEIK |
| BCMA_EBB-C1979-C12 - nt ScFv domain | 274 | GAAGTGCAGCTCGTGGAGAGCGGGGGAGGATTGGTGCAGCCCGGAAGG TCCCTGCGGCTCTCCTGCACTGCGTCTGGCTTCACCTTCGACGACTAC GCGATGCACTGGGTCAGACAGCGCCCGGGAAAGGGCCTGGAATGGGTC GCCTCAATCAACTGGAAGGGAAACTCCCTGGCCTATGGCGACAGCGTG AAGGGCCGCTTCGCCATTTCGCGCGACAACGCCAAGAACACCGTGTTT CTGCAAATGAATTCCCTGCGGACCGAGGATACCGCTGTGTACTACTGC GCCAGCCACCAGGGCGTGGCATACTATAACTACGCCATGGACGTGTGG GGAAGAGGGACGCTCGTCACCGTGTCCTCCGGGGCGGTGGATCGGGT GGAGGAGGAAGCGGTGGCGGGGCAGCGAAATCGTGCTGACTCAGAGC CCGGGAACTCTTTCACTGTCCCCGGGAGAACGGGCCACTCTCTCGTGC CGGGCCACCCAGTCCATCGGCTCCTCTTCCTTGCCTGGTACCAGCAG AGGCCAGGACAGGCGCCCCGCCTGCTGATCTACGGTGCTTCCCAACGC GCCACTGGCATTCCTGACCGGTTCAGCGGCAGAGGGTCGGGAACCGAT TTCACACTGACCATTTCCCGGGTGGAGCCCGAAGATTCGGCAGTCTAC TACTGTCAGCATTACGAGTCCTCCCCTTCATGGACCTTCGGTCAAGGG ACCAAAGTGGAGATCAAG |

TABLE 8-continued

Amino Acid and Nucleic Acid Sequences of exemplary anti-BCMA scFv domains and BCMA CAR molecules

| Name/ Description | SEQ ID NO: | Sequence |
| --- | --- | --- |
| BCMA_EBB-C1979-C12 - aa VH | 275 | EVQLVESGGGLVQPGRSLRLSCTASGFTFDDYAMHWVRQRPGKGLEWV ASINWKGNSLAYGDSVKGRFAISRDNAKNTVFLQMNSLRTEDTAVYYC ASHQGVAYYNYAMDVWGRGTLVTVSS |
| BCMA_EBB-C1979-C12 - aa VL | 276 | EIVLTQSPGTLSLSPGERATLSCRATQSIGSSFLAWYQQRPGQAPRLL IYGASQRATGIPDRFSGRGSGTDFTLTISRVEPEDSAVYYCQHYESSP SWTFGQGTKVEIK |
| BCMA_EBB-C1979-C12 - aa Full CART | 277 | MALPVTALLLPLALLLHAARPEVQLVESGGGLVQPGRSLRLSCTASGF TFDDYAMHWVRQRPGKGLEWVASINWKGNSLAYGDSVKGRFAISRDNA KNTVFLQMNSLRTEDTAVYYCASHQGVAYYNYAMDVWGRGTLVTVSSG GGGSGGGGSGGGGSEIVLTQSPGTLSLSPGERATLSCRATQSIGSSFL AWYQQRPGQAPRLLIYGASQRATGIPDRFSGRGSGTDFTLTISRVEPE DSAVYYCQHYESSPSWTFGQGTKVEIKTTTPAPRPPTPAPTIASQPLS LRPEACRPAAGGAVHTRGLDFACDIYIWAPLAGTCGVLLLSLVITLYC KRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNP QEGLYNELQKDKMAEAYSEIGMKGERRRGKGHDGLYQGLSTATKDTYD ALHMQALPPR |
| BCMA_EBB-C1979-C12 - nt Full CART | 278 | ATGGCCCTCCCTGTCACCGCCCTGCTGCTTCCGCTGGCTCTTCTGCTC CACGCCGCTCGGCCCGAAGTGCAGCTCGTGGAGAGCGGGGGAGGATTG GTGCAGCCCGGAAGGTCCCTGCGGCTCTCCTGCACTGCGTCTGGCTTC ACCTTCGACGACTACGCGATGCACTGGGTCAGACAGCGCCCGGGAAAG GGCCTGGAATGGGTCGCCTCAATCAACTGGAAGGGAAACTCCCTGGCC TATGGCGACAGCGTGAAGGGCCGCTTCGCCATTTCGCGCGACAACGCC AAGAACACCGTGTTTCTGCAAATGAATTCCCTGCGGACCGAGGATACC GCTGTGTACTACTGCGCCAGCCACCAGGGCGTGGCATACTATAACTAC GCCATGGACGTGTGGGGAAGAGGGACGCTCGTCACCGTGTCCTCCGGG GGCGGTGGATCGGGTGGAGGAGGAAGCGGTGGCGGGGGCAGCGAAATC GTGCTGACTCAGAGCCCGGGAACTCTTTCACTGTCCCGGGAGAACGG GCCACTCTCTCGTGCCGGGCCACCCAGTCCATCGGCTCCTCCTTCCTT GCCTGGTACCAGCAGAGGCCAGGACAGGCGCCCCGCCTGCTGATCTAC GGTGCTTCCCAACGCGCCACTGGCATTCCTGACCGGTTCAGCGGCAGA GGGTCGGGAACCGATTTCACACTGACCATTTCCCGGGTGGAGCCCGAA GATTCGGCAGTCTACTACTGTCAGCATTACGAGTCCTCCCCTTCATGG ACCTTCGGTCAAGGGACCAAAGTGGAGATCAAGACCACTACCCCAGCA CCGAGGCCACCCACCCCGGCTCCTACCATCGCCTCCCAGCCTCTGTCC CTGCGTCCGGAGGCATGTAGACCCGCAGCTGGTGGGGCCGTGCATACC CGGGGTCTTGACTTCGCCTGCGATATCTACATTTGGGCCCCTCTGGCT GGTACTTGCGGGGTCCTGCTGCTTTCACTCGTGATCACTCTTTACTGT AAGCGCGGTCGGAAGAAGCTGCTGTACATCTTTAAGCAACCCTTCATG AGGCCTGTGCAGACTACTCAAGAGGAGGACGGCTGTTCATGCCGGTTC CCAGAGGAGGAGGAAGGCGGCTGCGAACTGCGCGTGAAATTCAGCCGC AGCGCAGATGCTCCAGCCTACAAGCAGGGCAGAACCAGCTCTACAAC GAACTCAATCTTGGTCGGAGAGAGGAGTACGACGTGCTGGACAAGCGG AGAGGACGGGACCCAGAAATGGGCGGGAAGCCGCGCAGAAAGAATCCC CAAGAGGGCCTGTACAACGAGCTCCAAAAGGATAAGATGGCAGAAGCC TATAGCGAGATTGGTATGAAAGGGGAACGCAGAAGAGGCAAAGGCCAC GACGGACTGTACCAGGGACTCAGCACCGCCACCAAGGACACCTATGAC GCTCTTCACATGCAGGCCCTGCCGCCTCGG |

BCMA_EBB-C1980-G4

| Name/ Description | SEQ ID NO: | Sequence |
| --- | --- | --- |
| BCMA_EBB-C1980-G4- aa ScFv domain | 279 | EVQLVESGGGLVQPGGSLRLSCAASGFTFSSYAMSWVRQAPGKGLEWV SAISGSGGSTYYADSVKGRFTISRDNSKNTLYLQMNSLRAEDTAVYYC AKVVRDGMDVWGQGTTVTVSSGGGGSGGGGSGGGGSEIVLTQSPATLS LSPGERATLSCRASQSVSSSYLAWYQQKPGQAPRLLIYGASSRATGIP DRFSGNGSGTDFTLTISRLEPEDFAVYYCQQYGSPPRFTFGPGTKVDI K |
| BCMA_EBB-C1980-G4- nt ScFv domain | 280 | GAGGTGCAGTTGGTCGAAAGCGGGGGCGGGCTTGTGCAGCCTGGCGGA TCACTGCGGCTGTCCTGCGCGGCATCAGGCTTCACGTTTTCTTCCTAC GCCATGTCCTGGGTGCGCCAGGCCCCTGGAAAGGGACTGGAATGGGTG TCCGCGATTTCGGGGTCCGGCGGGAGCACCTACTACGCCGATTCCGTG AAGGGCCGCTTCACTATCTCGCGGGACAACTCCAAGAACACCCTCTAC CTCCAAATGAATAGCCTGCGGGCCGAGGATACCGCCGTCTACTATTGC GCTAAGGTCGTGCGCGACGGAATGGACGTGTGGGGACAGGGTACCACC GTGACAGTGTCCTCGGGGGGAGGCGGTAGCGGCGGAGGAGGAAGCGGT GGTGGAGGTTCCGAGATTGTGCTGACTCAATCACCCGCGACCCTGAGC |

TABLE 8-continued

Amino Acid and Nucleic Acid Sequences of exemplary anti-BCMA scFv domains and BCMA CAR molecules

| Name/Description | SEQ ID NO: | Sequence |
|---|---|---|
| | | CTGTCCCCCGGCGAAAGGGCCACTCTGTCCTGTCGGGCCAGCCAATCA<br>GTCTCCTCCTCGTACCTGGCCTGGTACCAGCAGAAGCCAGGACAGGCT<br>CCCGAGACTCCTTATCTATGGCGCATCCTCCCGCGCCACCGGAATCCCG<br>GATAGGTTCTCGGGAAACGGATCGGGGACCGACTTCACTCTCACCATC<br>TCCCGGCTGGAACCGGAGGACTTCGCCGTGTACTACTGCCAGCAGTAC<br>GGCAGCCCGCCTAGATTCACTTTCGGCCCCGGCACCAAAGTGGACATC<br>AAG |
| BCMA_EBB-C1980-G4-aa VH | 281 | EVQLVESGGGLVQPGGSLRLSCAASGFTFSSYAMSWVRQAPGKGLEWV<br>SAISGSGGSTYYADSVKGRFTISRDNSKNTLYLQMNSLRAEDTAVYYC<br>AKVVRDGMDVWGQGTTVTVSS |
| BCMA_EBB-C1980-G4-aa VL | 282 | EIVLTQSPATLSLSPGERATLSCRASQSVSSSYLAWYQQKPGQAPRLL<br>IYGASSRATGIPDRFSGNGSGTDFTLTISRLEPEDFAVYYCQQYGSPP<br>RFTFGPGTKVDIK |
| BCMA_EBB-C1980-G4-aa Full CART | 283 | MALPVTALLLPLALLLHAARPEVQLVESGGGLVQPGGSLRLSCAASGF<br>TFSSYAMSWVRQAPGKGLEWVSAISGSGGSTYYADSVKGRFTISRDNS<br>KNTLYLQMNSLRAEDTAVYYCAKVVRDGMDVWGQGTTVTVSSGGGGSG<br>GGGSGGGGSEIVLTQSPATLSLSPGERATLSCRASQSVSSSYLAWYQQ<br>KPGQAPRLLIYGASSRATGIPDRFSGNGSGTDFTLTISRLEPEDFAVY<br>YCQQYGSPPRFTFGPGTKVDIKTTTPAPRPPTPAPTIASQPLSLRPEA<br>CRPAAGGAVHTRGLDFACDIYIWAPLAGTCGVLLLSLVITLYCKRGRK<br>KLLYIFKQPFMRPVQTTQEEDGCSCRFPEEEEGGCELRVKFSRSADAP<br>AYKQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQ<br>ALPPR |
| BCMA_EBB-C1980-G4-nt Full CART | 284 | ATGGCCCTCCCTGTCACCGCCCTGCTGCTTCCGCTGGCTCTTCTGCTC<br>CACGCCGCTCGGCCCGAGGTGCAGTTGGTCGAAAGCGGGGGCGGGCTT<br>GTGCAGCCTGGCGGATCACTGCGGCTGTCCTGCGCGGCATCAGGCTTC<br>ACGTTTTCTTCCTACGCCATGTCCTGGGTGCGCCAGGCCCCTGGAAAG<br>GGACTGGAATGGGTGTCCGCGATTTCGGGGTCCGGCGGGAGCACCTAC<br>TACGCCGATTCCGTGAAGGGCCGCTTCACTATCTCGCGGGACAACTCC<br>AAGAACACCCTCTACCTCCAAATGAATAGCCTGCGGGCCGAGGATACC<br>GCCGTCTACTATTGCGCTAAGGTCGTGCGCGACGGAATGGACGTGTGG<br>GGACAGGGTACCACCGTGACAGTGTCCTCGGGGGGAGGCGGTAGCGGC<br>GGAGGAGGAAGCGGTGGTGGAGGTTCCGAGATTGTGCTGACTCAATCA<br>CCCGCGACCCTGAGCCTGTCCCCCGGCGAAAGGGCCACTCTGTCCTGT<br>CGGGCCAGCCAATCAGTCTCCTCCTCGTACCTGGCCTGGTACCAGCAG<br>AAGCCAGGACAGGCTCCCGAGACTCCTTATCTATGGCGCATCCTCCCGC<br>GCCACCGGAATCCCGGATAGGTTCTCGGGAAACGGATCGGGGACCGAC<br>TTCACTCTCACCATCTCCCGGCTGGAACCGGAGGACTTCGCCGTGTAC<br>TACTGCCAGCAGTACGGCAGCCCGCCTAGATTCACTTTCGGCCCCGGC<br>ACCAAAGTGGACATCAAGACCACTACCCCAGCACCGAGGCCACCCACC<br>CCGGCTCCTACCATCGCCTCCCAGCCTCTGTCCCTGCGTCCGGAGGCA<br>TGTAGACCCGCAGCTGGTGGGGCCGTGCATACCCGGGGTCTTGACTTC<br>GCCTGCGATATCTACATTTGGGCCCCTCTGGCTGGTACTTGCGGGGTC<br>CTGCTGCTTTCACTCGTGATCACTCTTTACTGTAAGCGCGGTCGGAAG<br>AAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAA<br>GGCGGCTGCGAACTGCGCGTGAAATTCAGCCGCAGCGCAGATGCTCCA<br>GCCTACAAGCAGGGGCAGAACCAGCTCTACAACGAACTCAATCTTGGT<br>CGGAGAGAGGAGTACGACGTGCTGGACAAGCGGAGAGGACGGGACCCA<br>GAAATGGGCGGGAAGCCGCGCAGAAAGAATCCCCAAGAGGGCCTGTAC<br>AACGAGCTCCAAAAGGATAAGATGGCAGAAGCCTATAGCGAGATTGGT<br>ATGAAAGGGAACGCAGAAGAGGCAAAGGCCACGACGGACTGTACCAG<br>GGACTCAGCACCGCCACCAAGGACACCTATGACGCTCTTCACATGCAG<br>GCCCTGCCGCCTCGG |

BCMA_EBB-C1980-D2

| Name/Description | SEQ ID NO: | Sequence |
|---|---|---|
| BCMA_EBB-C1980-D2-aa ScFv domain | 285 | EVQLLESGGGLVQPGGSLRLSCAASGFTFSSYAMSWVRQAPGKGLEWV<br>SAISGSGGSTYYADSVKGRFTISRDNSKNTLYLQMNSLRAEDTAVYYC<br>AKIPQTGTFDYWGQGTLVTVSSGGGGSGGGGSGGGGSEIVLTQSPGTL<br>SLSPGERATLSCRASQSVSSSYLAWYQQRPGQAPRLLIYGASSRATGI<br>PDRFSGSGSGTDFTLTISRLEPEDFAVYYCQHYGSSPSWTFGQGTRLE<br>IK |
| BCMA_EBB-C1980- | 286 | GAAGTGCAGCTGCTGGAGTCCGGCGGTGGATTGGTGCAACCGGGGGGA<br>TCGCTCAGACTGTCCTGTGCGGCGTCAGGCTTCACCTTCTCGAGCTAC |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| D2- nt ScFv domain | | GCCATGTCATGGGTCAGACAGGCCCCTGGAAAGGGTCTGGAATGGGTG TCCGCCATTTCCGGGAGCGGGGGATCTACATACTACGCCGATAGCGTG AAGGGCCGCTTCACCATTTCCCGGGACAACTCCAAGAACACTCTCTAT CTGCAAATGAACTCCCTCCGCGCTGAGGACACTGCCGTGTACTACTGC GCCAAAATCCCTCAGACCGGCACCTTCGACTACTGGGGACAGGGGACT CTGGTCACCGTCAGCAGCGGTGGCGGAGGTTCGGGGGGAGGAGGAAGC GGCGGCGGAGGGTCCGAGATTGTGCTGACCCAGTCACCCGGCACTTTG TCCCTGTCGCCTGGAGAAAGGGCCACCCTTTCCTGCCGGGCATCCCAA TCCGTGTCCTCCTCGTACCTGGCCTGGTACCAGCAGAGGCCCGGACAG GCCCCACGGCTTCTGATCTACGGAGCAAGCAGCCGCGGACCGGTATC CCGGACCGGTTTTCGGGCTCGGGCTCAGGAACTGACTTCACCCTCACC ATCTCCCGCCTGGAACCCGAAGATTTCGCTGTGTATTACTGCCAGCAC TACGGCAGCTCCCCGTCCTGGACGTTCGGCCAGGGAACTCGGCTGGAG ATCAAG |
| BCMA_EBB- C1980- D2- aa VH | 287 | EVQLLESGGGLVQPGGSLRLSCAASGFTFSSYAMSWVRQAPGKGLEWV SAISGSGGSTYYADSVKGRFTISRDNSKNTLYLQMNSLRAEDTAVYYC AKIPQTGTFDYWGQGTLVTVSS |
| BCMA_EBB- C1980- D2- aa VL | 288 | EIVLTQSPGTLSLSPGERATLSCRASQSVSSSYLAWYQQRPGQAPRLL IYGASSRATGIPDRFSGSGSGTDFTLTISRLEPEDFAVYYCQHYGSSP SWTFGQGTRLEIK |
| BCMA_EBB- C1980- D2- aa Full CART | 289 | MALPVTALLLPLALLLHAARPEVQLLESGGGLVQPGGSLRLSCAASGF TFSSYAMSWVRQAPGKGLEWVSAISGSGGSTYYADSVKGRFTISRDNS KNTLYLQMNSLRAEDTAVYYCAKIPQTGTFDYWGQGTLVTVSSGGGGS GGGGSGGGGSEIVLTQSPGTLSLSPGERATLSCRASQSVSSSYLAWYQ QRPGQAPRLLIYGASSRATGIPDRFSGSGSGTDFTLTISRLEPEDFAV YYCQHYGSSPSWTFGQGTRLEIKTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR |
| BCMA_EBB- C1980- D2- nt Full CART | 290 | ATGGCCCTCCCTGTCACCGCCCTGCTGCTTCCGCTGGCTCTTCTGCTC CACGCCGCTCGGCCCGAAGTGCAGCTGCTGGAGTCCGGAGGCGGACTG GTGCAACCGGGGGGATCGCTCAGACTGTCCTGTGCGGCGTCAGGCTTC ACCTTCTCGAGCTACGCCATGTCATGGGTCAGACAGGCCCCTGGAAAG GGTCTGGAATGGGTGTCCGCCATTTCCGGGAGCGGGGGATCTACATAC TACGCCGATAGCGTGAAGGGCCGCTTCACCATTTCCCGGGACAACTCC AAGAACACTCTCTATCTGCAAATGAACTCCCTCCGCGCTGAGGACACT GCCGTGTACTACTGCGCCAAAATCCCTCAGACCGGCACCTTCGACTAC TGGGGACAGGGGACTCTGGTCACCGTCAGCAGCGGTGGCGGAGGTTCG GGGGGAGGAGGAAGCGGCGGCGGAGGGTCCGAGATTGTGCTGACCCAG TCACCCGGCACTTTGTCCCTGTCGCCTGGAGAAAGGGCCACCCTTTCC TGCCGGGCATCCCAATCCGTGTCCTCCTCGTACCTGGCCTGGTACCAG CAGAGGCCCGGACAGGCCCCACGGCTTCTGATCTACGGAGCAAGCAGC CGCGCGACCGGTATCCCGGACCGGTTTTCGGGCTCGGGCTCAGGAACT GACTTCACCCTCACCATCTCCCGCCTGGAACCCGAAGATTTCGCTGTG TATTACTGCCAGCACTACGGCAGCTCCCCGTCCTGGACGTTCGGCCAG GGAACTCGGCTGGAGATCAAGACCACTACCCCAGCACCGAGGCCACCC ACCCCGGCTCCTACCATCGCCTCCCAGCCTCTGTCCCTGCGTCCGGAG GCATGTAGACCCGCAGCTGGTGGGGCCGTGCATACCCGGGGTCTTGAC TTCGCCTGCGATATCTACATTTGGGCCCCTCTGGCTGGTACTTGCGGG GTCCTGCTGCTTTCACTCGTGATCACTCTTTACTGTAAGCGCGGTCGG AAGAAGCTGCTGTACATCTTTAAGCAACCCTTCATGAGGCCTGTGCAG ACTACTCAAGAGGAGGACGGCTGTTCATGCCGGTTCCCAGAGGAGGAG GAAGGCGGCTGCGAACTGCGCGTGAAATTCAGCCGCAGCGCAGATGCT CCAGCCTACAAGCAGGGGCAGAACCAGCTCTACAACGAACTCAATCTT GGTCGGAGAGAGGAGTACGACGTGCTGGACAAGCGGAGAGGACGGGAC CCAGAAATGGGCGGGAAGCCCGCGCAGAAAGAATCCCCAAGAGGGCCTG TACAACGAGCTCCAAAAGGATAAGATGGCAGAAGCCTATAGCGAGATT GGTATGAAAGGGGAACGCAGAAGAGGCAAAGGCCACGACGGACTGTAC CAGGGACTCAGCACCGCCACCAAGGACACCTATGACGCTCTTCACATG CAGGCCCTGCCGCCTCGG |

BCMA_EBB-C1978-A10

| BCMA_EBB- C1978- | 291 | EVQLVETGGGLVQPGGSLRLSCAASGFTFSSYAMSWVRQAPGKGLEWV SAISGSGGSTYYADSVKGRFTMSRENDKNSVFLQMNSLRVEDTGVYYC |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| A10- aa ScFv domain | | ARANYKRELRYYYGMDVWGQGTMVTVSSGGGGSGGGGSGGGGSEIVMT QSPGTLSLSPGESATLSCRASQRVASNYLAWYQHKPGQAPSLLISGAS SRATGVPDRFSGSGSGTDFTLAISRLEPEDSAVYYCQHYDSSPSWTFG QGTKVEIK |
| BCMA_EBB-C1978- A10- nt ScFv domain | 292 | GAAGTGCAACTGGTGGAAACCGGTGGAGGACTCGTGCAGCCTGGCGGC AGCCTCCGGCTGAGCTGCGCCGCTTCGGGATTCACCTTTTCCTCCTAC GCGATGTCTTGGGTCAGACAGGCCCCCGGAAAGGGGCTGGAATGGGTG TCAGCCATCTCCGGCTCCGGCGGATCAACGTACTACGCCGACTCCGTG AAAGGCCGGTTCACCATGTCGCGCGAGAATGACAAGAACTCCGTGTTC CTGCAAATGAACTCCCTGAGGGTGGAGGACACCGGAGTGTACTATTGT GCGCGCGCCAACTACAAGAGAGAGCTGCGGTACTACTACGGAATGGAC GTCTGGGGACAGGGAACTATGGTGACCGTGTCATCCGGTGGAGGGGGA AGCGGCGGTGGAGGCAGCGGGGGCGGGGGTTCAGAAATTGTCATGACC CAGTCCCCGGGAACTCTTTCCCTCTCCCCGGGGAATCCGCGACTTTG TCCTGCCGGGCCAGCCAGCGCGTGGCCTCGAACTACCTCGCATGGTAC CAGCATAAGCCAGGCCAAGCCCCTTCCCTGCTGATTTCCGGGGCTAGC AGCCGCGCCACTGGCGTGCCGGATAGGTTCTCGGGAAGCGGCTCGGGT ACCGATTTCACCCTGGCAATCTCGCGGCTGGAACCGGAGGATTCGGCC GTGTACTACTGCCAGCACTATGACTCATCCCCCTCCTGGACATTCGGA CAGGGCACCAAGGTCGAGATCAAG |
| BCMA_EBB-C1978- A10- aa VH | 293 | EVQLVETGGGLVQPGGSLRLSCAASGFTFSSYAMSWVRQAPGKGLEWV SAISGSGGSTYYADSVKGRFTMSRENDKNSVFLQMNSLRVEDTGVYYC ARANYKRELRYYYGMDVWGQGTMVTVSS |
| BCMA_EBB-C1978- A10- aa VL | 294 | EIVMTQSPGTLSLSPGESATLSCRASQRVASNYLAWYQHKPGQAPSLL ISGASSRATGVPDRFSGSGSGTDFTLAISRLEPEDSAVYYCQHYDSSP SWTFGQGTKVEIK |
| BCMA_EBB-C1978- A10- aa Full CART | 295 | MALPVTALLLPLALLLHAARPEVQLVETGGGLVQPGGSLRLSCAASGF TFSSYAMSWVRQAPGKGLEWVSAISGSGGSTYYADSVKGRFTMSREND KNSVFLQMNSLRVEDTGVYYCARANYKRELRYYYGMDVWGQGTMVTVS SGGGGSGGGGSGGGGSEIVMTQSPGTLSLSPGESATLSCRASQRVASN YLAWYQHKPGQAPSLLISGASSRATGVPDRFSGSGSGTDFTLAISRLE PEDSAVYYCQHYDSSPSWTFGQGTKVEIKTTTPAPRPPTPAPTIASQP LSLRPEACRPAAGGAVHTRGLDFACDIYIWAPLAGTCGVLLLSLVITL YCKRGRKKLLYIFKQPFMRPVQTTQEEDGCSCRFPEEEEGGCELRVKF SRSADAPAYKQGQNQLYNELNLGRREEYDVLDKRRGRDPEMGGKPRRK NPQEGLYNELQKDKMAEAYSEIGMKGERRRGKGHDGLYQGLSTATKDT YDALHMQALPPR |
| BCMA_EBB-C1978- A10- nt Full CART | 296 | ATGGCCCTCCCTGTCACCGCCCTGCTGCTTCCGCTGGCTCTTCTGCTC CACGCCGCTCGGCCCGAAGTGCAACTGGTGGAAACCGGTGGAGGACTC GTGCAGCCTGGCGGCAGCCTCCGGCTGAGCTGCGCCGCTTCGGGATTC ACCTTTTCCTCCTACGCGATGTCTTGGGTCAGACAGGCCCCCGGAAAG GGGCTGGAATGGGTGTCAGCCATCTCCGGCTCCGGCGGATCAACGTAC TACGCCGACTCCGTGAAAGGCCGGTTCACCATGTCGCGCGAGAATGAC AAGAACTCCGTGTTCCTGCAAATGAACTCCCTGAGGGTGGAGGACACC GGAGTGTACTATTGTGCGCGCGCCAACTACAAGAGAGAGCTGCGGTAC TACTACGGAATGGACGTCTGGGGACAGGGAACTATGGTGACCGTGTCA TCCGGTGGAGGGGGAAGCGGCGGTGGAGGCAGCGGGGGCGGGGGTTCA GAAATTGTCATGACCCAGTCCCCGGGAACTCTTTCCCTCTCCCCCGGG GAATCCGCGACTTTGTCCTGCCGGGCCAGCCAGCGCGTGGCCTCGAAC TACCTCGCATGGTACCAGCATAAGCCAGGCCAAGCCCCTTCCCTGCTG ATTTCCGGGGCTAGCAGCCGCGCCACTGGCGTGCCGGATAGGTTCTCG GGAAGCGGCTCGGGTACCGATTTCACCCTGGCAATCTCGCGGCTGGAA CCGGAGGATTCGGCCGTGTACTACTGCCAGCACTATGACTCATCCCCC TCCTGGACATTCGGACAGGGCACCAAGGTCGAGATCAAGACCACTACC CCAGCACCGAGGCCACCCACCCCGGCTCCTACCATCGCCTCCCAGCCT CTGTCCCTGCGTCCGGAGGCATGTAGACCCGCAGCTGGTGGGGCCGTG CATACCCGGGGTCTTGACTTCGCCTGCGATATCTACATTTGGGCCCCT CTGGCTGGTACTTGCGGGGTCCTGCTGCTTTCACTCGTGATCACTCTT TACTGTAAGCGCGGTCGGAAGAAGCTGCTGTACATCTTTAAGCAACCC TTCATGAGGCCTGTGCAGACTACTCAAGAGGAGGACGGCTGTTCATGC CGGTTCCCAGAGGAGGAAGAGGGCTGCGAACTGCGCGTGAAATTC AGCCGCAGCGCAGATGCTCCAGCCTACAAGCAGGGGCAGAACCAGCTC TACAACGAACTCAATCTTGGTCGGAGAGAGGAGTACGACGTGCTGGAC AAGCGGAGAGGACGGGACCCAGAAATGGGCGGGAAGCCGCGCAGAAAG AATCCCCAAGAGGGCCTGTACAACGAGCTCCAAAAGGATAAGATGGCA GAAGCCTATAGCGAGATTGGTATGAAAGGGGAACGCAGAAGAGGCAAA |

TABLE 8-continued

Amino Acid and Nucleic Acid Sequences of exemplary anti-BCMA scFv domains and BCMA CAR molecules

| Name/Description | SEQ ID NO: | Sequence |
|---|---|---|
| | | GGCCACGACGGACTGTACCAGGGACTCAGCACCGCCACCAAGGACACC TATGACGCTCTTCACATGCAGGCCCTGCCGCCTCGG |

BCMA_EBB-C1978-D4

| Name/Description | SEQ ID NO: | Sequence |
|---|---|---|
| BCMA_EBB-C1978-D4- aa ScFv domain | 297 | EVQLLETGGGLVQPGGSLRLSCAASGFSFSSYAMSWVRQAPGKGLEWV SAISGSGGSTYYADSVKGRFTISRDNSKNTLYLQMNSLRAEDTAVYYC AKALVGATGAFDIWGQGTLVTVSSGGGGSGGGGSGGGGSEIVLTQSPG TLSLSPGERATLSCRASQSLSSNFLAWYQQKPGQAPGLLIYGASNWAT GTPDRFSGSGSGTDFTLTITRLEPEDFAVYYCQYYGTSPMYTFGQGTK VEIK |
| BCMA_EBB-C1978-D4- nt ScFv domain | 298 | GAAGTGCAGCTGCTCGAAACCGGTGGAGGGCTGGTGCAGCCAGGGGGC TCCCTGAGGCTTTCATGCGCCGCTAGCGGATTCTCCTTCTCCTCTTAC GCCATGTCGTGGGTCCGCCAAGCCCCTGGAAAAGGCCTGGAATGGGTG TCCGCGATTTCCGGGAGCGGAGGTTCGACCTATTACGCCGACTCCGTG AAGGGCCGCTTTACCATCTCCCGGGATAACTCCAAGAACACTCTGTAC CTCCAAATGAACTCGCTGAGAGCCGAGGACACCGCCGTGTATTACTGC GCGAAGGCGCTGGTCGGCGCGACTGGGGCATTCGACATCTGGGGACAG GGAACTCTTGTGACCGTGTCGAGCGGAGGCGGCGGCTCCGGCGGAGGA GGGAGCGGGGGCGGTGGTTCCGAAATCGTGTTGACTCAGTCCCCGGGA ACCCTGAGCTTGTCACCCGGGGAGCGGGCCACTCTCTCCTGTCGCGCC TCCCAATCGCTCTCATCCAATTTCCTGGCCTGGTACCAGCAGAAGCCC GGACAGGCCCCGGGCCTGCTCATCTACGGCGCTTCAAACTGGGCAACG GGAACCCCTGATCGGTTCAGCGGAAGCGGATCGGGTACTGACTTTACC CTGACCATCACCAGACTGGAACCGGAGGACTTCGCCGTGTACTACTGC CAGTACTACGGCACCTCCCCCATGTACACATTCGGACAGGGTACCAAG GTCGAGATTAAG |
| BCMA_EBB-C1978-D4- aa VH | 299 | EVQLLETGGGLVQPGGSLRLSCAASGFSFSSYAMSWVRQAPGKGLEWV SAISGSGGSTYYADSVKGRFTISRDNSKNTLYLQMNSLRAEDTAVYYC AKALVGATGAFDIWGQGTLVTVSS |
| BCMA_EBB-C1978-D4- aa VL | 300 | EIVLTQSPGTLSLSPGERATLSCRASQSLSSNFLAWYQQKPGQAPGLL IYGASNWATGTPDRFSGSGSGTDFTLTITRLEPEDFAVYYCQYYGTSP MYTFGQGTKVEIK |
| BCMA_EBB-C1978-D4- aa Full CART | 301 | MALPVTALLLPLALLLHAARPEVQLLETGGGLVQPGGSLRLSCAASGF SFSSYAMSWVRQAPGKGLEWVSAISGSGGSTYYADSVKGRFTISRDNS KNTLYLQMNSLRAEDTAVYYCAKALVGATGAFDIWGQGTLVTVSSGGG GSGGGGSGGGGSEIVLTQSPGTLSLSPGERATLSCRASQSLSSNFLAW YQQKPGQAPGLLIYGASNWATGTPDRFSGSGSGTDFTLTITRLEPEDF AVYYCQYYGTSPMYTFGQGTKVEIKTTTPAPRPPTPAPTIASQPLSLR PEACRPAAGGAVHTRGLDFACDIYIWAPLAGTCGVLLLSLVITLYCKR GRKKLLYIFKQPFMRPVQTTQEEDGCSCRFPEEEEGGCELRVKFSRSA DAPAYKQGQNQLYNELNLGRREEYDVLDKRRGRDPEMGGKPRRKNPQE GLYNELQKDKMAEAYSEIGMKGERRRGKGHDGLYQGLSTATKDTYDAL HMQALPPR |
| BCMA_EBB-C1978-D4- nt Full CART | 302 | ATGGCCCTCCCTGTCACCGCCCTGCTGCTTCCGCTGGCTCTTCTGCTC CACGCCGCTCGGCCCGAAGTGCAGCTGCTCGAAACCGGTGGAGGGCTG GTGCAGCCAGGGGGCTCCCTGAGGCTTTCATGCGCCGCTAGCGGATTC TCCTTCTCCTCTTACGCCATGTCGTGGGTCCGCCAAGCCCCTGGAAAA GGCCTGGAATGGGTGTCCGCGATTTCCGGGAGCGGAGGTTCGACCTAT TACGCCGACTCCGTGAAGGGCCGCTTTACCATCTCCCGGGATAACTCC AAGAACACTCTGTACCTCCAAATGAACTCGCTGAGAGCCGAGGACACC GCCGTGTATTACTGCGCGAAGGCGCTGGTCGGCGCGACTGGGGCATTC GACATCTGGGGACAGGGAACTCTTGTGACCGTGTCGAGCGGAGGCGGC GGCTCCGGCGGAGGAGGGAGCGGGGGCGGTGGTTCCGAAATCGTGTTG ACTCAGTCCCCGGGAACCCTGAGCTTGTCACCCGGGGAGCGGGCCACT CTCTCCTGTCGCGCCTCCCAATCGCTCTCATCCAATTTCCTGGCCTGG TACCAGCAGAAGCCCGGACAGGCCCCGGGCCTGCTCATCTACGGCGCT TCAAACTGGGCAACGGGAACCCCTGATCGGTTCAGCGGAAGCGGATCG GGTACTGACTTTACCCTGACCATCACCAGACTGGAACCGGAGGACTTC GCCGTGTACTACTGCCAGTACTACGGCACCTCCCCCATGTACACATTC GGACAGGGTACCAAGGTCGAGATTAAGACCACCACCCCAGCACCGAGG CCACCCACCCCGGCTCCTACCATCGCCTCCCAGCCTCTGTCCCTGCGT CCGGAGGCATGTAGACCCGCAGCTGGTGGGCCGTGCATACCCGGGGT CTTGACTTCGCCTGCGATATCTACATTTGGGCCCCTCTGGCTGGTACT TGCGGGGTCCTGCTGCTTTCACTCGTGATCACTCTTTACTGTAAGCGC GGTCGGAAGAAGCTGCTGTACATCTTTAAGCAACCCTTCATGAGGCCT |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| | | GTGCAGACTACTCAAGAGGAGGACGGCTGTTCATGCCGGTTCCCAGAG GAGGAGGAAGGCGGCTGCGAACTGCGCGTGAAATTCAGCCGCAGCGCA GATGCTCCAGCCTACAAGCAGGGGCAGAACCAGCTCTACAACGAACTC AATCTTGGTCGGAGAGAGGAGTACGACGTGCTGGACAAGCGGAGAGGA CGGGACCCAGAAATGGGCGGGAAGCCGCGCAGAAAGAATCCCCAAGAG GGCCTGTACAACGAGCTCCAAAAGGATAAGATGGCAGAAGCCTATAGC GAGATTGGTATGAAAGGGGAACGCAGAAGAGGCAAAGGCCACGACGGA CTGTACCAGGGACTCAGCACCGCCACCAAGGACACCTATGACGCTCTT CACATGCAGGCCCTGCCGCCTCGG |

BCMA_EBB-C1980-A2

| Name/ Description | SEQ ID NO: | Sequence |
|---|---|---|
| BCMA_EBB-C1980-A2- aa ScFv domain | 303 | EVQLLESGGGLVQPGGSLRLSCAASGFTFSSYAMSWVRQAPGKGLEWV SAISGSGGSTYYADSVKGRFTISRDNSKNTLYLQMNSLRAEDTAVYYC VLWFGEGFDPWGQGTLVTVSSGGGGSGGGGSGGGGSDIVLTQSPLSLP VTPGEPASISCRSSQSLLHSNGYNYLDWYLQKPGQSPQLLIYLGSNRA SGVPDRFSGSGSGTDFTLKISRVEAEDVGVYYCMQALQTPLTFGGGTK VDIK |
| BCMA_EBB-C1980-A2- nt ScFv domain | 304 | GAAGTGCAGCTGCTTGAGAGCGGTGGAGGTCTGGTGCAGCCCGGGGGA TCACTGCGCCTGTCCTGTGCCGCGTCCGGTTTCACTTTCTCCTCGTAC GCCATGTCGTGGGTCAGACAGGCACCGGGAAAGGGACTGGAATGGGTG TCAGCCATTTCGGGTTCGGGGGGCAGCACCTACTACGCTGACTCCGTG AAGGGCCGGTTCACCATTTCCCGCGACAACTCCAAGAACACCTTGTAC CTCCAAATGAACTCCCTGCGGGCCGAAGATACCGCCGTGTATTACTGC GTGCTGTGGTTCGGAGAGGGATTCGACCCGTGGGGACAAGGACACTC GTGACTGTGTCATCCGGCGGAGGCGGCAGCGGTGGCGGCGGTTCCGGC GGCGGCGGATCTGACATCGTGTTGACCCAGTCCCCTCTGAGCCTGCCG GTCACTCCTGGCGAACCAGCCAGCATCTCCTGCCGGTCGAGCCAGTCC CTCCTGCACTCCAATGGGTACAACTACCTCGATTGGTATCTGCAAAAG CCGGGCCAGAGCCCCCAGCTGCTGATCTACCTTGGGTCAAACCGCGCT TCCGGGGTGCCTGATAGATTCTCCGGGTCCGGGAGCGGAACCGACTTT ACCCTGAAAATCTCGAGGGTGGAGGCCGAGGACGTCGGAGTGTACTAC TGCATGCAGGCGCTCCAGACTCCCCTGACCTTCGGAGGAGGAACGAAG GTCGACATCAAGA |
| BCMA_EBB-C1980-A2- aa VH | 305 | EVQLLESGGGLVQPGGSLRLSCAASGFTFSSYAMSWVRQAPGKGLEWV SAISGSGGSTYYADSVKGRFTISRDNSKNTLYLQMNSLRAEDTAVYYC VLWFGEGFDPWGQGTLVTVSS |
| BCMA_EBB-C1980-A2- aa VL | 306 | DIVLTQSPLSLPVTPGEPASISCRSSQSLLHSNGYNYLDWYLQKPGQS PQLLIYLGSNRASGVPDRFSGSGSGTDFTLKISRVEAEDVGVYYCMQA LQTPLTFGGGTKVDIK |
| BCMA_EBB-C1980-A2- aa Full CART | 307 | MALPVTALLLPLALLLHAARPEVQLLESGGGLVQPGGSLRLSCAASGF TFSSYAMSWVRQAPGKGLEWVSAISGSGGSTYYADSVKGRFTISRDNS KNTLYLQMNSLRAEDTAVYYCVLWFGEGFDPWGQGTLVTVSSGGGGSG GGGSGGGGSDIVLTQSPLSLPVTPGEPASISCRSSQSLLHSNGYNYLD WYLQKPGQSPQLLIYLGSNRASGVPDRFSGSGSGTDFTLKISRVEAED VGVYYCMQALQTPLTFGGGTKVDIKTTTPAPRPPTPAPTIASQPLSLR PEACRPAAGGAVHTRGLDFACDIYIWAPLAGTCGVLLLSLVITLYCKR GRKKLLYIFKQPFMRPVQTTQEEDGCSCRFPEEEEGGCELRVKFSRSA DAPAYKQGQNQLYNELNLGRREEYDVLDKRRGRDPEMGGKPRRKNPQE GLYNELQKDKMAEAYSEIGMKERRRGKGHDGLYQGLSTATKDTYDAL HMQALPPR |
| BCMA_EBB-C1980-A2- nt Full CART | 308 | ATGGCCCTCCCTGTCACCGCCCTGCTGCTTCCGCTGGCTCTTCTGCTC CACGCCGCTCGGCCCGAAGTGCAGCTGCTTGAGAGCGGTGGAGGTCTG GTGCAGCCCGGGGGATCACTGCGCCTGTCCTGTGCCGCGTCCGGTTTC ACTTTCTCCTCGTACGCCATGTCGTGGGTCAGACAGGCACCGGGAAAG GGACTGGAATGGGTGTCAGCCATTTCGGGTTCGGGGGGCAGCACCTAC TACGCTGACTCCGTGAAGGGCCGGTTCACCATTTCCCGCGACAACTCC AAGAACACCTTGTACCTCCAAATGAACTCCCTGCGGGCCGAAGATACC GCCGTGTATTACTGCGTGCTGTGGTTCGGAGAGGGATTCGACCCGTGG GGACAAGGAACACTCGTGACTGTGTCATCCGGCGGAGGCGGCAGCGGT GGCGGCGGTTCCGGCGGCGGCGGATCTGACATCGTGTTGACCCAGTCC CCTCTGAGCCTGCCGGTCACTCCTGGCGAACCAGCCAGCATCTCCTGC CGGTCGAGCCAGTCCCTCCTGCACTCCAATGGGTACAACTACCTCGAT TGGTATCTGCAAAAGCCGGGCCAGAGCCCCCAGCTGCTGATCTACCTT GGGTCAAACCGCGCTTCCGGGGTGCCTGATAGATTCTCCGGGTCCGGG AGCGGAACCGACTTTACCCTGAAAATCTCGAGGGTGGAGGCCGAGGAC |

TABLE 8-continued

Amino Acid and Nucleic Acid Sequences of exemplary anti-BCMA scFv domains and BCMA CAR molecules

| Name/Description | SEQ ID NO: | Sequence |
|---|---|---|
| | | GTCGGAGTGTACTACTGCATGCAGGCGCTCCAGACTCCCCTGACCTTC<br>GGAGGAGGAACGAAGGTCGACATCAAGACCACTACCCCAGCACCGAGG<br>CCACCCACCCCGGCTCCTACCATCGCCTCCCAGCCTCTGTCCCTGCGT<br>CCGGAGGCATGTAGACCCGCAGCTGGTGGGGCCGTGCATACCCGGGGT<br>CTTGACTTCGCCTGCGATATCTACATTTGGGCCCCTCTGGCTGGTACT<br>TGCCGGGTCCTGCTGCTTTCACTCGTGATCACTCTTTACTGTAAGCGC<br>GGTCGGAAGAAGCTGCTGTACATCTTTAAGCAACCCTTCATGAGGCCT<br>GTGCAGACTACTCAAGAGGAGGACGGCTGTTCATGCCGGTTCCCAGAG<br>GAGGAGGAAGGCGGCTGCGAACTGCGCGTGAAATTCAGCCGCAGCGCA<br>GATGCTCCAGCCTACAAGCAGGGGCAGAACCAGCTCTACAACGAACTC<br>AATCTTGGTCGGAGAGAGGAGTACGACGTGCTGGACAAGCGGAGAGGA<br>CGGGACCCAGAAATGGGCGGGAAGCCGCGCAGAAAGAATCCCCAAGAG<br>GGCCTGTACAACGAGCTCCAAAAGGATAAGATGGCAGAAGCCTATAGC<br>GAGATTGGTATGAAAGGGGAACGCAGAAGAGGCAAAGGCCACGACGGA<br>CTGTACCAGGGACTCAGCACCGCCACCAAGGACACCTATGACGCTCTT<br>CACATGCAGGCCCTGCCGCCTCGG |

BCMA_EBB-C1981-C3

| Name/Description | SEQ ID NO: | Sequence |
|---|---|---|
| BCMA_EBB-C1981-C3- aa ScFv domain | 309 | QVQLVESGGGLVQPGGSLRLSCAASGFTFSSYAMSWVRQAPGKGLEWV<br>SAISGSGGSTYYADSVKGRFTISRDNSKNTLYLQMNSLRAEDTAVYYC<br>AKVGYDSSGYYRDYYGMDVWGQGTTVTVSSGGGGSGGGGSGGGGSEIV<br>LTQSPGTLSLSPGERATLSCRASQSVSSSYLAWYQQKPGQAPRLLIYG<br>TSSRATGISDRFSGSGSGTDFTLTISRLEPEDFAVYYCQHYGNSPPKF<br>TFGPGTKLEIK |
| BCMA_EBB-C1981-C3- nt ScFv domain | 310 | CAAGTGCAGCTCGTGGAGTCAGGCGGAGGACTGGTGCAGCCCGGGGGC<br>TCCCTGAGACTTTCCTGCGCGGCATCGGGTTTTACCTTCTCCTCCTAT<br>GCTATGTCCTGGGTGCGCCAGGCCCCGGGAAAGGGACTGGAATGGGTG<br>TCCGCAATCAGCGGTAGCGGGGGCTCAACATACTACGCCGACTCCGTC<br>AAGGGTCGCTTCACTATTTCCCGGGACAACTCCAAGAATACCCTGTAC<br>CTCCAAATGAACAGCCTCAGGGCCGAGGATACTGCCGTGTACTACTGC<br>GCCAAAGTCGGATACGATAGCTCCGGTTACTACCGGGACTACTACGGA<br>ATGGACGTGTGGGGACAGGGCACCACCGTGACCGTGTCAAGCGGCGGA<br>GGCGGTTCAGGAGGGGGAGGCTCCGGCGGTGGAGGGTCCGAAATCGTC<br>CTGACTCAGTCGCCTGGCACTCTGTCGTTGTCCCCGGGGGAGCGCGCT<br>ACCCTGTCGTGTCGGGCGTCGCAGTCCGTGTCGAGCTCCTACCTCGCG<br>TGGTACCAGCAGAAGCCCGGACAGGCCCCTAGACTTCTGATCTACGGC<br>ACTTCTTCACGCGCCACCGGGATCAGCGACAGGTTCAGCGGCTCCGGC<br>TCCGGGACCGACTTCACCCTGACCATTAGCCGGCTGGAGCCTGAAGAT<br>TTCGCCGTGTATTACTGCCAACACTACGGAAACTCGCCGCCAAAGTTC<br>ACGTTCGGACCCGGAACCAAGCTGGAAATCAAG |
| BCMA_EBB-C1981-C3- aa VH | 311 | QVQLVESGGGLVQPGGSLRLSCAASGFTFSSYAMSWVRQAPGKGLEWV<br>SAISGSGGSTYYADSVKGRFTISRDNSKNTLYLQMNSLRAEDTAVYYC<br>AKVGYDSSGYYRDYYGMDVWGQGTTVTVSS |
| BCMA_EBB-C1981-C3- aa VL | 312 | EIVLTQSPGTLSLSPGERATLSCRASQSVSSSYLAWYQQKPGQAPRLL<br>IYGTSSRATGISDRFSGSGSGTDFTLTISRLEPEDFAVYYCQHYGNSP<br>PKFTFGPGTKLEIK |
| BCMA_EBB-C1981-C3- aa Full CART | 313 | MALPVTALLLPLALLLHAARPQVQLVESGGGLVQPGGSLRLSCAASGF<br>TFSSYAMSWVRQAPGKGLEWVSAISGSGGSTYYADSVKGRFTISRDNS<br>KNTLYLQMNSLRAEDTAVYYCAKVGYDSSGYYRDYYGMDVWGQGTTVT<br>VSSGGGGSGGGGSGGGGSEIVLTQSPGTLSLSPGERATLSCRASQSVS<br>SSYLAWYQQKPGQAPRLLIYGTSSRATGISDRFSGSGSGTDFTLTISR<br>LEPEDFAVYYCQHYGNSPPKFTFGPGTKLEIKTTTPAPRPPTPAPTIA<br>SQPLSLRPEACRPAAGGAVHTRGLDFACDIYIWAPLAGTCGVLLLSLV<br>ITLYCKRGRKKLLYIFKQPFMRPVQTTQEEDGCSCRFPEEEEGGCELR<br>VKFSRSADAPAYKQGQNQLYNELNLGRREEYDVLDKRRGRDPEMGGKP<br>RRKNPQEGLYNELQKDKMAEAYSEIGMKGERRRGKGHDGLYQGLSTAT<br>KDTYDALHMQALPPR |
| BCMA_EBB-C1981-C3- nt Full CART | 314 | ATGGCCCTCCCTGTCACCGCCCTGCTGCTTCCGCTGGCTCTTCTGCTC<br>CACGCCGCTCGGCCCCAAGTGCAGCTCGTGGAGTCAGGCGGAGGACTG<br>GTGCAGCCCGGGGGCTCCCTGAGACTTTCCTGCGCGGCATCGGGTTTT<br>ACCTTCTCCTCCTATGCTATGTCCTGGGTGCGCCAGGCCCCGGGAAAG<br>GGACTGGAATGGGTGTCCGCAATCAGCGGTAGCGGGGGCTCAACATAC<br>TACGCCGACTCCGTCAAGGGTCGCTTCACTATTTCCCGGGACAACTCC<br>AAGAATACCCTGTACCTCCAAATGAACAGCCTCAGGGCCGAGGATACT<br>GCCGTGTACTACTGCGCCAAAGTCGGATACGATAGCTCCGGTTACTAC |

TABLE 8-continued

Amino Acid and Nucleic Acid Sequences of exemplary anti-BCMA scFv domains and BCMA CAR molecules

| Name/<br>Description | SEQ<br>ID<br>NO: | Sequence |
|---|---|---|
| | | CGGGACTACTACGGAATGGACGTGTGGGGACAGGGCACCACCGTGACC<br>GTGTCAAGCGGCGGAGGCGGTTCAGGAGGGGGAGGCTCCGGCGGTGGA<br>GGGTCCGAAATCGTCCTGACTCAGTCGCCTGGCACTCTGTCGTTGTCC<br>CCGGGGGAGCGCGCTACCCTGTCGTGTCGGGCGTCGCAGTCCGTGTCG<br>AGCTCCTACCTCGCGTGGTACCAGCAGAAGCCCGGACAGGCCCCTAGA<br>CTTCTGATCTACGGCACTTCTTCACGCGCCACCGGGATCAGCGACAGG<br>TTCAGCGGCTCCGGCTCCGGGACCGACTTCACCCTGACCATTAGCCGG<br>CTGGAGCCTGAAGATTTCGCCGTGTATTACTGCCAACACTACGGAAAC<br>TCGCCGCCAAAGTTCACGTTCGGACCCGGAACCAAGCTGGAAATCAAG<br>ACCACTACCCCAGCACCGAGGCCACCCACCCCGGCTCCTACCATCGCC<br>TCCCAGCCTCTGTCCCTGCGTCCGGAGGCATGTAGACCCGCAGCTGGT<br>GGGGCCGTGCATACCCGGGGTCTTGACTTCGCCTGCGATATCTACATT<br>TGGGCCCCTCTGGCTGGTACTTGCGGGGTCCTGCTGCTTTCACTCGTG<br>ATCACTCTTTTACTGTAAGCGCGGTCGGAAGAAGCTGCTGTACATCTTT<br>AAGCAACCCTTCATGAGGCCTGTGCAGACTACTCAAGAGGAGGACGGC<br>TGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAG<br>AACCAGCTCTACAACGAACTCAATCTTGGTCGGAGAGAGGAGTACGAC<br>GTGCTGGACAAGCGGAGAGGACGGGACCCAGAAATGGGCGGGAAGCCG<br>CGCAGAAAGAATCCCCAAGAGGGCCTGTACAACGAGCTCCAAAAGGAT<br>AAGATGGCAGAAGCCTATAGCGAGATTGGTATGAAAGGGGAACGCAGA<br>AGAGGCAAAGGCCACGACGGACTGTACCAGGGACTCAGCACCGCCACC<br>AAGGACACCTATGACGCTCTTCACATGCAGGCCCTGCCGCCTCGG |
| | | BCMA_EBB-C1978-G4 |
| BCMA_EBB-<br>C1978-<br>G4- aa<br>ScFv<br>domain | 315 | EVQLVESGGGLVQPGGSLRLSCAASGFTSSYAMSWVRQAPGKGLEWV<br>SAISGSGGSTYYADSVKGRFTISRDNSKNTLYLQMNSLRAEDTAVYYC<br>AKMGWSSGYLGAFDIWGQGTTVTVSSGGGGSGGGGSGGGGSEIVLTQS<br>PGTLSLSPGERATLSCRASQSVASSFLAWYQQKPGQAPRLLIYGASGR<br>ATGIPDRFSGSGSGTDFTLTISRLEPEDFAVYYCQHYGGSPRLTFGGG<br>TKVDIK |
| BCMA_EBB-<br>C1978-<br>G4- nt<br>ScFv<br>domain | 316 | GAAGTCCAACTGGTGGAGTCCGGGGGAGGGCTCGTGCAGCCCGGAGGC<br>AGCCTTCGGCTGTCGTGCGCCGCCTCCGGGTTCACGTTCTCATCCTAC<br>GCGATGTCGTGGGTCAGACAGGCACCAGGAAAGGGACTGGAATGGGTG<br>TCCGCCATTAGCGGCTCCGGCGGTAGCACCTACTATGCCGACTCAGTG<br>AAGGGAAGGTTCACTATCTCCCGCGACAACAGCAAGAACACCCTGTAC<br>CTCCAAATGAACTCTCTGCGGGCCGAGGATACCGCGGTGTACTATTGC<br>GCCAAGATGGGTTGGTCCAGCGGATACTTGGGAGCCTTCGACATTTGG<br>GGACAGGGCACTACTGTGACCGTGTCCTCCGGGGGTGGCGGATCGGGA<br>GGCGGCGGCTCGGGTGGAGGGGGTTCCGAAATCGTGTTGACCCAGTCA<br>CCGGGAACCCTCTCGCTGTCCCCGGGAGAACGGGCTACACTGTCATGT<br>AGAGCGTCCCAGTCCGTGGCTTCCTCGTTCCTGGCCTGGTACCAGCAG<br>AAGCCGGGACAGGCACCCCGCCTGCTCATCTACGGAGCCAGCGGCCGG<br>GCGACCGGCATCCCTGACCGCTTCTCCGGTTCCGGCTCGGGCACCGAC<br>TTTACTCTGACCATTAGCAGGCTTGAGCCCGAGGATTTTGCCGTGTAC<br>TACTGCCAACACTACGGGGGAGCCCTCGCCTGACCTTCGGAGGCGGA<br>ACTAAGGTCGATATCAAAA |
| BCMA_EBB-<br>C1978-<br>G4- aa<br>VH | 317 | EVQLVESGGGLVQPGGSLRLSCAASGFTSSYAMSWVRQAPGKGLEWV<br>SAISGSGGSTYYADSVKGRFTISRDNSKNTLYLQMNSLRAEDTAVYYC<br>AKMGWSSGYLGAFDIWGQGTTVTVSS |
| BCMA_EBB-<br>C1978-<br>G4- aa<br>VL | 318 | EIVLTQSPGTLSLSPGERATLSCRASQSVASSFLAWYQQKPGQAPRLL<br>IYGASGRATGIPDRFSGSGSGTDFTLTISRLEPEDFAVYYCQHYGGSP<br>RLTFGGGTKVDIK |
| BCMA_EBB-<br>C1978-<br>G4- aa<br>Full CART | 319 | MALPVTALLLPLALLLHAARPEVQLVESGGGLVQPGGSLRLSCAASGF<br>TFSSYAMSWVRQAPGKGLEWVSAISGSGGSTYYADSVKGRFTISRDNS<br>KNTLYLQMNSLRAEDTAVYYCAKMGWSSGYLGAFDIWGQGTTVTVSSG<br>GGGSGGGGSGGGGSEIVLTQSPGTLSLSPGERATLSCRASQSVASSFL<br>AWYQQKPGQAPRLLIYGASGRATGIPDRFSGSGSGTDFTLTISRLEPE<br>DFAVYYCQHYGGSPRLTFGGGTKVDIKTTTPAPRPPTPAPTIASQPLS<br>LRPEACRPAAGGAVHTRGLDFACDIYIWAPLAGTCGVLLLSLVITLYC<br>KRGRKKLLYIFKQPFMRPVQTTQEEDGCSCRFPEEEEGGCELRVKFSR<br>SADAPAYKQGQNQLYNELNLGRREEYDVLDKRRGRDPEMGGKPRRKNP<br>QEGLYNELQKDKMAEAYSEIGMKGERRRGKGHDGLYQGLSTATKDTYD<br>ALHMQALPPR |

TABLE 8-continued

Amino Acid and Nucleic Acid Sequences of exemplary anti-BCMA scFv domains and BCMA CAR molecules

| Name/ Description | SEQ ID NO: | Sequence |
|---|---|---|
| BCMA_EBB-C1978-G4- nt Full CART | 320 | ATGGCCCTCCCTGTCACCGCCCTGCTGCTTCCGCTGGCTCTTCTGCTC<br>CACGCCGCTCGGCCCGAAGTCCAACTGGTGGAGTCCGGGGGAGGGCTC<br>GTGCAGCCCGGAGGCAGCCTTCGGCTGTCGTGCGCCGCCTCCGGGTTC<br>ACGTTCTCATCCTACGCGATGTCGTGGGTCAGACAGGCACCAGGAAAG<br>GGACTGGAATGGGTGTCCGCCATTAGCGGCTCCGGCGGTAGCACCTAC<br>TATGCCGACTCAGTGAAGGGAAGGTTCACTATCTCCCGCGACAACAGC<br>AAGAACACCCTGTACCTCCAAATGAACTCTCTGCGGGCCGAGGATACC<br>GCGGTGTACTATTGCGCCAAGATGGGTTGGTCCAGCGGATACTTGGGA<br>GCCTTCGACATTTGGGGACAGGGCACTACTGTGACCGTGTCCTCCGGG<br>GGTGGCGGATCGGGAGGCGGCGGCTCGGGTGGAGGGGGTTCCGAAATC<br>GTGTTGACCCAGTCACCGGGAACCCTCTCGCTGTCCCGGGAGAACGG<br>GCTACACTGTCATGTAGAGCGTCCCAGTCCGTGGCTTCCTCGTTCCTG<br>GCCTGGTACCAGCAGAAGCCGGGACAGGCACCCCGCCTGCTCATCTAC<br>GGAGCCAGCGGCCGGGCGACCGGCATCCCTGACCGCTTCTCCGGTTCC<br>GGCTCGGGCACCGACTTTACTCTGACCATTAGCAGGCTTGAGCCCGAG<br>GATTTTGCCGTGTACTACTGCCAACACTACGGGGGAGCCCTCGCCTG<br>ACCTTCGGAGGCGGAACTAAGGTCGATATCAAAACCACTACCCCAGCA<br>CCGAGGCCACCCACCCCGGCTCCTACCATCGCCTCCCAGCCTCTGTCC<br>CTGCGTCCGGAGGCATGTAGACCCGCAGCTGGTGGGGCCGTGCATACC<br>CGGGGTCTTGACTTCGCCTGCGATATCTACATTTGGGCCCCTCTGGCT<br>GGTACTTGCGGGGTCCTGCTGCTTTCACTCGTGATCACTCTTTACTGT<br>AAGCGCGGTCGGAAGAAGCTGCTGTACATCTTTAAGCAACCCTTCATG<br>AGGCCTGTGCAGACTACTCAAGAGGAGGACGGCTGTTCATGCCGGTTC<br>CCAGAGGAGGAGGAAGGCGGCTGCGAACTGCGCGTGAAATTCAGCCGC<br>AGCGCAGATGCTCCAGCCTACAAGCAGGGGCAGAACCAGCTCTACAAC<br>GAACTCAATCTTGGTCGGAGAGAGGAGTACGACGTGCTGGACAAGCGG<br>AGAGGACGGGACCCAGAAATGGGCGGGAAGCCGCGCAGAAAGAATCCC<br>CAAGAGGGCCTGTACAACGAGCTCCAAAAGGATAAGATGGCAGAAGCC<br>TATAGCGAGATTGGTATGAAAGGGGAACGCAGAAGAGGCAAAGGCCAC<br>GACGGACTGTACCAGGGACTCAGCACCGCCACCAAGGACACCTATGAC<br>GCTCTTCACATGCAGGCCCTGCCGCCTCGG |

TABLE 9

Additional exemplary BCMA CAR sequences

| Name | Sequence | SEQ ID NO: |
|---|---|---|
| A7D12.2 VH | QIQLVQSGPDLKKPGETVKLSCKASGYTFTNFGMNWVKQAPGKGFKWMAWINTYTGESYFA<br>DDFKGRFAFSVETSATTAYLQINNLKTEDTATYFCARGEIYYGYDGGFAYWGQGTLVTVSA | 321 |
| A7D12.2 VL | DVVMTQSHRFMSTSVGDRVSITCRASQDVNTAVSWYQQKPGQSPKLLIFSASYRYTGVPDR<br>FTGSGSGADFTLTISSVQAEDLAVYYCQQHYSTPWTFGGGTKLDIK | 322 |
| A7D12.2 scFv domain | QIQLVQSGPDLKKPGETVKLSCKASGYTFTNFGMNWVKQAPGKGFKWMAWINTYTGESYFA<br>DDFKGRFAFSVETSATTAYLQINNLKTEDTATYFCARGEIYYGYDGGFAYWGQGTLVTVSA<br>GGGGSGGGGSGGGGSDVVMTQSHRFMSTSVGDRVSITCRASQDVNTAVSWYQQKPGQSPKL<br>LIFSASYRYTGVPDRFTGSGSGADFTLTISSVQAEDLAVYYCQQHYSTPWTFGGGTKLDIK | 323 |
| A7D12.2 Full CART | QIQLVQSGPDLKKPGETVKLSCKASGYTFTNFGMNWVKQAPGKGFKWMAWINTYTGESYFA<br>DDFKGRFAFSVETSATTAYLQINNLKTEDTATYFCARGEIYYGYDGGFAYWGQGTLVTVSA<br>GGGGSGGGGSGGGGSDVVMTQSHRFMSTSVGDRVSITCRASQDVNTAVSWYQQKPGQSPKL<br>LIFSASYRYTGVPDRFTGSGSGADFTLTISSVQAEDLAVYYCQQHYSTPWTFGGGTKLDIK<br>TTTPAPRPPTPAPTIASQPLSLRPEACRPAAGGAVHTRGLDFACDIYIWAPLAGTCGVLLL<br>SLVITLYCKRGRKKLLYIFKQPFMRPVQTTQEEDGCSCRFPEEEEGGCELRVKFSRSADAP<br>AYKQGQNQLYNELNLGRREEYDVLDKRRGRDPEMGGKPRRKNPQEGLYNELQKDKMAEAYS<br>EIGMKGERRRGKGHDGLYQGLSTATKDTYDALHMQALPPR | 324 |
| C11D5.3 VH | QIQLVQSGPELKKPGETVKISCKASGYTFTDYSINWVKRAPGKGLKWMGWINTETREPAYA<br>YDFRGRFAFSLETSASTAYLQINNLKYEDTATYFCALDYSYAMDYWGQGTSVTVSS | 325 |
| C11D5.3 VL | DIVLTQSPASLAMSLGKRATISCRASESVSVIGAHLIHWYQQKPGQPPKLLIYLASNLETG<br>VPARFSGSGSGTDFTLTIDPVEEDDVAIYSCLQSRIFPRTFGGGTKLEIK | 326 |

TABLE 9-continued

Additional exemplary BCMA CAR sequences

| Name | Sequence | SEQ ID NO: |
|---|---|---|
| C11D5.3 scFv domain | QIQLVQSGPELKKPGETVKISCKASGYTFTDYSINWVKRAPGKGLKWMGWINTETREPAYA YDFRGRFAFSLETSASTAYLQINNLKYEDTATYFCALDYSYAMDYWGQGTSVTVSSGGGGS GGGGSGGGGSQIQLVQSGPELKKPGETVKISCKASGYTFTDYSINWVKRAPGKGLKWMGWI NTETREPAYAYDFRGRFAFSLETSASTAYLQINNLKYEDTATYFCALDYSYAMDYWGQGTS VTVSS | 327 |
| C11D5.3 Full CART | QIQLVQSGPELKKPGETVKISCKASGYTFTDYSINWVKRAPGKGLKWMGWINTETREPAYA YDFRGRFAFSLETSASTAYLQINNLKYEDTATYFCALDYSYAMDYWGQGTSVTVSSGGGGS GGGGSGGGGSQIQLVQSGPELKKPGETVKISCKASGYTFTDYSINWVKRAPGKGLKWMGWI NTETREPAYAYDFRGRFAFSLETSASTAYLQINNLKYEDTATYFCALDYSYAMDYWGQGTS VTVSSTTTPAPRPPTPAPTIASQPLSLRPEACRPAAGGAVHTRGLDFACDIYIWAPLAGTC GVLLLSLVITLYCKRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR | 328 |
| C12A3.2 VH | QIQLVQSGPELKKPGETVKISCKASGYTFRHYSMNWVKQAPGKGLKWMGRINTESGVPIYA DDFKGRFAFSVETSASTAYLVINNLKDEDTASYFCSNDYLYSLDFWGQGTALTVSS | 329 |
| C12A3.2 VL | DIVLTQSPPSLAMSLGKRATISCRASESVTILGSHLIYWYQQKPGQPPTLLIQLASNVQTG VPARFSGSGSRTDFTLTIDPVEEDDVAVYYCLQSRTIPRTFGGGTKLEIK | 330 |
| C12A3.2 scFv domain | QIQLVQSGPELKKPGETVKISCKASGYTFRHYSMNWVKQAPGKGLKWMGRINTESGVPIYA DDFKGRFAFSVETSASTAYLVINNLKDEDTASYFCSNDYLYSLDFWGQGTALTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIK | 331 |
| C12A3.2 Full CART | QIQLVQSGPELKKPGETVKISCKASGYTFRHYSMNWVKQAPGKGLKWMGRINTESGVPIYA DDFKGRFAFSVETSASTAYLVINNLKDEDTASYFCSNDYLYSLDFWGQGTALTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIKT TTPAPRPPTPAPTIASQPLSLRPEACRPAAGGAVHTRGLDFACDIYIWAPLAGTCGVLLLS LVITLYCKRGRKKLLYIFKQPFMRPVQTTQEEDGCSCRFPEEEEGGCELRVKFSRSADAPA YKQGQNQLYNELNLGRREEYDVLDKRRGRDPEMGGKPRRKNPQEGLYNELQKDKMAEAYSE IGMKGERRRGKGHDGLYQGLSTATKDTYDALHMQALPPR | 332 |
| C13F12.1 VH | QIQLVQSGPELKKPGETVKISCKASGYTFTHYSMNWVKQAPGKGLKWMGRINTETGEPLYA DDFKGRFAFSLETSASTAYLVINNLKNEDTATFFCSNDYLYSCDYWGQGTTLTVSS | 333 |
| C13F12.1 VL | DIVLTQSPPSLAMSLGKRATISCRASESVTILGSHLIYWYQQKPGQPPTLLIQLASNVQTG VPARFSGSGSRTDFTLTIDPVEEDDVAVYYCLQSRTIPRTFGGGTKLEIK | 334 |
| C13F12.1 scFv domain | QIQLVQSGPELKKPGETVKISCKASGYTFTHYSMNWVKQAPGKGLKWMGRINTETGEPLYA DDFKGRFAFSLETSASTAYLVINNLKNEDTATFFCSNDYLYSCDYWGQGTTLTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIK | 335 |
| C13F12.1 Full CART | QIQLVQSGPELKKPGETVKISCKASGYTFTHYSMNWVKQAPGKGLKWMGRINTETGEPLYA DDFKGRFAFSLETSASTAYLVINNLKNEDTATFFCSNDYLYSCDYWGQGTTLTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIKT TTPAPRPPTPAPTIASQPLSLRPEACRPAAGGAVHTRGLDFACDIYIWAPLAGTCGVLLLS LVITLYCKRGRKKLLYIFKQPFMRPVQTTQEEDGCSCRFPEEEEGGCELRVKFSRSADAPA YKQGQNQLYNELNLGRREEYDVLDKRRGRDPEMGGKPRRKNPQEGLYNELQKDKMAEAYSE IGMKGERRRGKGHDGLYQGLSTATKDTYDALHMQALPPR | 336 |

Exemplary target antigens that can be targeted using the CAR-expressing cells, include, but are not limited to, CD19, CD123, EGFRvIII, mesothelin, among others, as described in, for example, WO 2014/130635, WO 2014/130657, and WO 2015/090230, each of which is herein incorporated by reference in its entirety.

In one embodiment, the CAR T cell that specifically binds to CD19 has the USAN designation TISAGENLECLEU-CEL-T. CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In other embodiments, the CAR-expressing cells can specifically bind to human CD19, e.g., can include a CAR molecule, or an antigen binding domain (e.g., a humanized antigen binding domain) according to Table 3 of WO2014/153270, incorporated herein by reference.

In embodiments, the CAR molecule comprises a CD19 CAR molecule described herein, e.g., a CD19 CAR molecule described in US-2015-0283178-A1, e.g., CTL019. In embodiments, the CD19 CAR comprises an amino acid, or has a nucleotide sequence shown in US-2015-0283178-A1, incorporated herein by reference.

In other embodiments, the CAR-expressing cells can specifically bind to CD123, e.g., can include a CAR molecule (e.g., any of the CAR1-CAR8), or an antigen binding domain according to Tables 1-2 of WO 2014/130635, incorporated herein by reference.

In an embodiment, the CAR molecule comprises a CD123 CAR described herein, e.g., a CD123 CAR described in US2014/0322212A1 or US2016/0068601A1, both incorporated herein by reference. In embodiments, the CD123 CAR comprises an amino acid, or has a nucleotide sequence shown in US2014/0322212A1 or US2016/0068601A1, both incorporated herein by reference.

In other embodiments, the CAR-expressing cells can specifically bind to EGFRvIII, e.g., can include a CAR molecule, or an antigen binding domain according to Table 2 or SEQ ID NO:11 of WO 2014/130657, incorporated herein by reference.

In an embodiment, the CAR molecule comprises an EGFRvIII CAR molecule described herein, e.g., an EGFRvIII CAR described US2014/0322275A1, incorporated herein by reference. In embodiments, the EGFRvIII CAR comprises an amino acid, or has a nucleotide sequence shown in US2014/0322275A1, incorporated herein by reference.

In other embodiments, the CAR-expressing cells can specifically bind to mesothelin, e.g., can include a CAR molecule, or an antigen binding domain according to Tables 2-3 of WO 2015/090230, incorporated herein by reference.

In an embodiment, the CAR molecule comprises a mesothelin CAR described herein, e.g., a mesothelin CAR described in WO 2015/090230, incorporated herein by reference. In embodiments, the mesothelin CAR comprises an amino acid, or has a nucleotide sequence shown in WO 2015/090230, incorporated herein by reference.

In one embodiment, CAR molecule comprises a BCMA CAR molecule described herein, e.g., a BCMA CAR described in US-2016-0046724-A1. In embodiments, the BCMA CAR comprises an amino acid, or has a nucleotide sequence shown in US-2016-0046724-A1, incorporated herein by reference.

In an embodiment, the CAR molecule comprises a CLL1 CAR described herein, e.g., a CLL1 CAR described in US2016/0051651A1, incorporated herein by reference. In embodiments, the CLL1 CAR comprises an amino acid, or has a nucleotide sequence shown in US2016/0051651A1, incorporated herein by reference.

In an embodiment, the CAR molecule comprises a CD33 CAR described herein, e.ga CD33 CAR described in US2016/0096892A1, incorporated herein by reference. In embodiments, the CD33 CAR comprises an amino acid, or has a nucleotide sequence shown in US2016/0096892A1, incorporated herein by reference.

In one embodiment, the antigen binding domain comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed or described above.

In some embodiments, the tumor antigen is a tumor antigen described in International Application WO2015/142675, which is herein incorporated by reference. In some embodiments, the tumor antigen is chosen from one or more of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bDGalp(1-4)bDGlcp(1-1) Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAXS); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

In accordance with any method or composition described herein, in embodiments, a CAR molecule comprises a CD123 CAR described herein, e.g., a CD123 CAR described in US2014/0322212A1 or US2016/0068601A1, both incorporated herein by reference. In embodiments, the CD123 CAR comprises an amino acid, or has a nucleotide sequence shown in US2014/0322212A1 or US2016/0068601A1, both incorporated herein by reference. In other embodiments, a CAR molecule comprises a CD19 CAR molecule described herein, e.g., a CD19 CAR molecule described in US-2015-0283178-A1, e.g., CTL019. In embodiments, the CD19 CAR comprises an amino acid, or has a nucleotide sequence shown in US-2015-0283178-A1, incorporated herein by reference. In one embodiment, CAR molecule comprises a BCMA CAR molecule described herein, e.g., a BCMA CAR described in US-2016-0046724-A1. In embodiments, the BCMA CAR comprises an amino acid, or has a nucleotide sequence shown in US-2016-0046724-A1, incorporated herein by reference. In an embodiment, the CAR molecule comprises a CLL1 CAR described herein, e.g., a CLL1 CAR described in US2016/0051651A1, incorporated herein by reference. In embodiments, the CLL1 CAR comprises an amino acid, or has a nucleotide sequence shown in US2016/0051651A1, incorporated herein by reference. In an embodiment, the CAR molecule comprises a CD33 CAR described herein, e.g., a CD33 CAR described in US2016/0096892A1, incorporated herein by reference. In embodiments, the CD33 CAR comprises an amino acid, or has a nucleotide sequence shown in US2016/0096892A1, incorporated herein by reference. In an embodiment, the CAR molecule comprises an EGFRvIII CAR molecule described herein, e.g., an EGFRvIII CAR described US2014/0322275A1, incorporated herein by reference. In embodiments, the EGFRvIII CAR comprises an amino acid, or has a nucleotide sequence shown in US2014/0322275A1, incorporated herein by reference. In an embodiment, the CAR molecule comprises a mesothelin CAR described herein, e.g., a mesothelin CAR described in WO 2015/090230, incorporated herein by reference. In embodiments, the mesothelin CAR comprises an amino acid, or has a nucleotide sequence shown in WO 2015/090230, incorporated herein by reference.

Exemplary CD19 CARs include CD19 CARs described herein, e.g., in one or more tables described herein, or an anti-CD19 CAR described in Xu et al. Blood 123.24(2014): 3750-9; Kochenderfer et al. Blood 122.25(2013):4129-39, Cruz et al. Blood 122.17(2013):2965-73, NCT00586391, NCT01087294, NCT02456350, NCT00840853, NCT02659943, NCT02650999, NCT02640209, NCT01747486, NCT02546739, NCT02656147, NCT02772198, NCT00709033, NCT02081937, NCT00924326, NCT02735083, NCT02794246, NCT02746952, NCT01593696, NCT02134262, NCT01853631, NCT02443831, NCT02277522, NCT02348216, NCT02614066, NCT02030834, NCT02624258, NCT02625480, NCT02030847, NCT02644655, NCT02349698, NCT02813837, NCT02050347, NCT01683279, NCT02529813, NCT02537977, NCT02799550, NCT02672501, NCT02819583, NCT02028455, NCT01840566, NCT01318317, NCT01864889, NCT02706405, NCT01475058, NCT01430390, NCT02146924, NCT02051257, NCT02431988, NCT01815749, NCT02153580, NCT01865617, NCT02208362, NCT02685670, NCT02535364, NCT02631044, NCT02728882, NCT02735291, NCT01860937, NCT02822326, NCT02737085, NCT02465983, NCT02132624, NCT02782351, NCT01493453, NCT02652910, NCT02247609, NCT01029366, NCT01626495, NCT02721407, NCT01044069, NCT00422383, NCT01680991, NCT02794961, or NCT02456207, each of which is incorporated herein by reference in its entirety.

In one embodiment, the antigen binding domain comprises one, two three (e.g., all three) heavy chain CDRs, HC CDR1, HC CDR2 and HC CDR3, from an antibody described herein (e.g., an antibody described in WO2015/142675, US-2015-0283178-A1, US-2016-0046724-A1, US2014/0322212A1, US2016/0068601A1, US2016/0051651A1, US2016/0096892A1, US2014/0322275A1, or WO2015/090230, incorporated herein by reference), and/or one, two, three (e.g., all three) light chain CDRs, LC CDR1, LC CDR2 and LC CDR3, from an antibody described herein (e.g., an antibody described in WO2015/142675, US-2015-0283178-A1, US-2016-0046724-A1, US2014/0322212A1, US2016/0068601A1, US2016/0051651A1, US2016/0096892A1, US2014/0322275A1, or WO2015/090230, incorporated herein by reference). In one embodiment, the antigen binding domain comprises a heavy chain variable region and/or a variable light chain region of an antibody listed above.

In embodiments, the antigen binding domain is an antigen binding domain described in WO2015/142675, US-2015-0283178-A1, US-2016-0046724-A1, US2014/0322212A1, US2016/0068601A1, US2016/0051651A1, US2016/0096892A1, US2014/0322275A1, or WO2015/090230, incorporated herein by reference.

In embodiments, the antigen binding domain targets BCMA and is described in US-2016-0046724-A1.

In embodiments, the antigen binding domain targets CD19 and is described in US-2015-0283178-A1.

In embodiments, the antigen binding domain targets CD123 and is described in US2014/0322212A1, US2016/0068601A1.

In embodiments, the antigen binding domain targets CLL and is described in US2016/0051651A1.

In embodiments, the antigen binding domain targets CD33 and is described in US2016/0096892A1.

Exemplary target antigens that can be targeted using the CAR-expressing cells, include, but are not limited to, CD19, CD123, EGFRvIII, CD33, mesothelin, BCMA, and GFR ALPHA-4, among others, as described in, for example, WO2014/153270, WO 2014/130635, WO2016/028896, WO 2014/130657, WO2016/014576, WO 2015/090230, WO2016/014565, WO2016/014535, and WO2016/025880, each of which is herein incorporated by reference in its entirety.

In other embodiments, the CAR-expressing cells can specifically bind to humanized CD19, e.g., can include a CAR molecule, or an antigen binding domain (e.g., a humanized antigen binding domain) according to Table 3 of WO2014/153270, incorporated herein by reference. The amino acid and nucleotide sequences encoding the CD19 CAR molecules and antigen binding domains (e.g., including one, two, three VH CDRs; and one, two, three VL CDRs according to Kabat or Chothia), are specified in WO2014/153270.

In other embodiments, the CAR-expressing cells can specifically bind to CD123, e.g., can include a CAR molecule (e.g., any of the CAR1 to CAR8), or an antigen binding domain according to Tables 1-2 of WO 2014/130635, incorporated herein by reference. The amino acid and nucleotide sequences encoding the CD123 CAR molecules and antigen binding domains (e.g., including one, two, three VH CDRs; and one, two, three VL CDRs according to Kabat or Chothia), are specified in WO 2014/130635.

In other embodiments, the CAR-expressing cells can specifically bind to CD123, e.g., can include a CAR molecule (e.g., any of the CAR123-1 ro CAR123-4 and hzCAR123-1 to hzCAR123-32), or an antigen binding domain according to Tables 2, 6, and 9 of WO2016/028896, incorporated herein by reference. The amino acid and nucleotide sequences encoding the CD123 CAR molecules and antigen binding domains (e.g., including one, two, three VH CDRs; and one, two, three VL CDRs according to Kabat or Chothia), are specified in WO2016/028896.

In other embodiments, the CAR-expressing cells can specifically bind to EGFRvIII, e.g., can include a CAR molecule, or an antigen binding domain according to Table 2 or SEQ ID NO:11 of WO 2014/130657, incorporated herein by reference. The amino acid and nucleotide sequences encoding the EGFRvIII CAR molecules and antigen binding domains (e.g., including one, two, three VH CDRs; and one, two, three VL CDRs according to Kabat or Chothia), are specified in WO 2014/130657.

In other embodiments, the CAR-expressing cells can specifically bind to CD33, e.g., can include a CAR molecule (e.g., any of CAR33-1 to CAR-33-9), or an antigen binding domain according to Table 2 or 9 of WO2016/014576, incorporated herein by reference. The amino acid and nucleotide sequences encoding the CD33 CAR molecules and antigen binding domains (e.g., including one, two, three VH CDRs; and one, two, three VL CDRs according to Kabat or Chothia), are specified in WO2016/014576.

In other embodiments, the CAR-expressing cells can specifically bind to mesothelin, e.g., can include a CAR molecule, or an antigen binding domain according to Tables 2-3 of WO 2015/090230, incorporated herein by reference. The amino acid and nucleotide sequences encoding the mesothelin CAR molecules and antigen binding domains (e.g., including one, two, three VH CDRs; and one, two, three VL CDRs according to Kabat or Chothia), are specified in WO 2015/090230.

In other embodiments, the CAR-expressing cells can specifically bind to BCMA, e.g., can include a CAR molecule, or an antigen binding domain according to Table 1 or 16, SEQ ID NO: 271 or SEQ ID NO: 273 of WO2016/014565, incorporated herein by reference. The amino acid and nucleotide sequences encoding the BCMA CAR molecules and antigen binding domains (e.g., including one, two, three VH CDRs; and one, two, three VL CDRs according to Kabat or Chothia), are specified in WO2016/014565.

In other embodiments, the CAR-expressing cells can specifically bind to CLL-1, e.g., can include a CAR molecule, or an antigen binding domain according to Table 2 of WO2016/014535, incorporated herein by reference. The amino acid and nucleotide sequences encoding the CLL-1 CAR molecules and antigen binding domains (e.g., including one, two, three VH CDRs; and one, two, three VL CDRs according to Kabat or Chothia), are specified in WO2016/014535.

In other embodiments, the CAR-expressing cells can specifically bind to GFR ALPHA-4, e.g., can include a CAR molecule, or an antigen binding domain according to Table 2 of WO2016/025880, incorporated herein by reference. The amino acid and nucleotide sequences encoding the GFR ALPHA-4 CAR molecules and antigen binding domains (e.g., including one, two, three VH CDRs; and one, two, three VL CDRs according to Kabat or Chothia), are specified in WO2016/025880.

In one embodiment, the antigen binding domain of any of the CAR molecules described herein (e.g., any of CD19, CD123, EGFRvIII, CD33, mesothelin, BCMA, and GFR ALPHA-4) comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antigen binding domain listed above. In one embodiment, the antigen binding domain comprises a heavy chain variable region and/or a variable light chain region of an antibody listed or described above.

Non-Antibody Scaffolds

In embodiments, the antigen binding domain comprises a non-antibody scaffold, e.g., a fibronectin, ankyrin, domain antibody, lipocalin, small modular immuno-pharmaceutical, maxybody, Protein A, or affilin. The non-antibody scaffold has the ability to bind to target antigen on a cell. In embodiments, the antigen binding domain is a polypeptide or fragment thereof of a naturally occurring protein expressed on a cell. In some embodiments, the antigen binding domain comprises a non-antibody scaffold. A wide variety of non-antibody scaffolds can be employed so long as the resulting polypeptide includes at least one binding region which specifically binds to the target antigen on a target cell.

Non-antibody scaffolds include: fibronectin (Novartis, Mass.), ankyrin (Molecular Partners AG, Zurich, Switzerland), domain antibodies (Domantis, Ltd., Cambridge, Mass., and Ablynx nv, Zwijnaarde, Belgium), lipocalin (Pieris Proteolab AG, Freising, Germany), small modular immuno-pharmaceuticals (Trubion Pharmaceuticals Inc., Seattle, Wash.), maxybodies (Avidia, Inc., Mountain View, Calif.), Protein A (Affibody AG, Sweden), and affilin (gamma-crystallin or ubiquitin) (Scil Proteins GmbH, Halle, Germany).

In an embodiment the antigen binding domain comprises the extracellular domain, or a counter-ligand binding fragment thereof, of molecule that binds a counterligand on the surface of a target cell.

Transmembrane Domain

In embodiments, a CAR described herein comprises a transmembrane domain that is fused to an extracellular sequence, e.g., an extracellular recognition element, which can comprise an antigen binding domain. In an embodiment, the transmembrane domain is one that naturally is associated with one of the domains in the CAR. In an embodiment, the transmembrane domain is one that is not naturally associated with one of the domains in the CAR.

A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region).

In embodiments, the transmembrane domain is one which minimizes interactions with other elements, e.g., other transmembrane domains. In some instances, the transmembrane domain minimizes binding of such domains to the transmembrane domains of the same or different surface membrane proteins, e.g., to minimize interactions with other members of the receptor complex. Suitable examples can be derived by selection or modification of amino acid substitution of a known transmembrane domain. In an embodiment, the transmembrane domain is capable of promoting homodimerization with another CAR on the cell surface.

The transmembrane domain may comprise a naturally occurring, or a non-naturally occurring synthetic sequence. Where naturally occurring, the transmembrane domain may be derived from any membrane-bound or transmembrane protein.

Transmembrane regions suitable for use in molecules described herein may be derived from any one or more of e.g., the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM (e.g., CEACAM-1, CEACAM-3 and/or CEACAM-5), CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C. In an embodiment the transmembrane domain is derived from CD8. In an embodiment the transmembrane domain is derived from CD28. In one aspect, the transmembrane domain is a transmembrane domain from the sequence provided as SEQ ID NO: 12 or SEQ ID NO: 42.

In an embodiment, a sequence, e.g., a hinge or spacer sequence, can be disposed between a transmembrane domain and another sequence or domain to which it is fused. In embodiments, a variety of human hinges (aka "spacers") can be employed as well, e.g., including but not limited to the human Ig (immunoglobulin) hinge. Optionally, a short oligo- or polypeptide linker, between 2 and 10 amino acids in length may form the linkage between the transmembrane domain and another domain, e.g., an intracellular signaling domain or costimulatory domain, of a CAR. A glycine-serine doublet provides a particularly suitable linker. In one aspect, the hinge or spacer is the amino acid sequence provided as SEQ ID NO: 4, SEQ ID NO: 6, or SEQ ID NO: 8. In one aspect, the hinge or spacer comprises a KIR2DS2 hinge.

In an embodiment, the transmembrane domain may be a non-naturally occurring sequence, in which case can comprise predominantly hydrophobic residues such as leucine and valine. In an embodiment, a triplet of phenylalanine, tryptophan and valine will be found at each end of a transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO:10). In some embodiments, the linker is encoded by a nucleotide sequence of GGTGGCGGAGGTTCTGGAGGTGGAGGTTCC (SEQ ID NO:11).

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced.

Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

Primary Signaling Domain

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, CD278 (also known as "ICOS"), FcεRI, DAP10, DAP12, and CD66d. In one embodiment, a CAR of the invention comprises an intracellular signaling domain, e.g., a primary signaling domain of CD3-zeta, e.g., a CD3-zeta sequence described herein.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs. Further examples of molecules containing a primary intracellular signaling domain that are of particular use in the invention include those of DAP10, DAP12, and CD32.

A primary intracellular signaling domain comprises a functional fragment, or analog, of a primary stimulatory molecule (e.g., CD3 zeta—GenBank Acc. No. BAG36664.1). The primary intracellular signaling domain can comprise the entire intracellular region or a fragment of the intracellular region which is sufficient for generation of an intracellular signal when an antigen binding domain to which it is fused binds cognate antigen. In embodiments the primary intracellular signaling domain has at least 70, 75, 80, 85, 90, 95, 98, or 99% sequence identity with the entire intracellular region, or a fragment of the intracellular region which is sufficient for generation of an intracellular signal, of a naturally occurring primary stimulatory molecule, e.g., a human (GenBank Acc No. BAG36664.1), or other mammalian, e.g., a nonhuman species, e.g., rodent, monkey, ape or murine intracellular primary stimulatory molecule. In embodiments the primary intracellular signaling domain has at least 70, 75, 80, 85, 90, 95, 98, or 99% sequence identity with SEQ ID NO: 18 or SEQ ID NO: 20.

In embodiments, the primary intracellular signaling domain, has at least 70, 75, 80, 85, 90, 95, 96, 97, 98, or 99% identity with, or differs by no more than 30, 25, 20, 15, 10, 5, 4, 3, 2, or 1 amino acid residues from the corresponding residues of the entire intracellular region, or a fragment of the intracellular region which is sufficient for generation of an intracellular signal, of a naturally occurring human primary stimulatory molecule, e.g., a naturally occurring human primary stimulatory molecule disclosed herein.

Costimulatory Signaling Domain

The intracellular signalling domain of the CAR can comprise the CD3-zeta signalling domain by itself or it can be combined with any other desired intracellular signalling domain(s) useful in the context of a CAR of the invention. For example, the intracellular signalling domain of the CAR can comprise a CD3 zeta chain portion and a costimulatory signaling domain. The costimulatory signaling domain refers to a portion of the CAR comprising the intracellular domain of a costimulatory molecule. In one embodiment, the intracellular domain is designed to comprise the signaling domain of CD3-zeta and the signaling domain of CD28. In one aspect, the intracellular domain is designed to comprise the signaling domain of CD3-zeta and the signaling domain of ICOS.

A costimulatory molecule can be a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CAR-expressing cell (e.g., T cell, NK cell) cells in vitro and augments human T cell persistence and antitumor activity in vivo (Song et al. BLOOD. 2012; 119(3):696-706). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKG2D, NKG2C, and PAG/Cbp.

In some embodiments, a population of immune effector cells, e.g., T cells, comprise a mixture of cells containing CAR molecules having two or more intracellular signaling domains. In embodiments, the population of immune effector cells comprise one or more CAR-comprising a CD28 signaling domain and a 4-1BB signaling domain. For example, a first immune effector cell comprises a CAR molecule comprising a CD28 signaling domain, and a second immune effector cell comprises a CAR molecule comprising a 4-1BB signaling domain. Expression of CAR molecules comprising a CD28 signaling domain and/or a 4-1BB signaling domain can be transient or stable.

The intracellular signaling sequences within the cytoplasmic portion of the CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequences. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

A costimulatory domain comprises a functional fragment, or analog, of a costimulatory molecule (e.g., ICOS, CD28, or 4-1BB). It can comprise the entire intracellular region or a fragment of the intracellular region which is sufficient for generation of an intracellular signal, e.g., when an antigen binding domain to which it is fused binds cognate antigen. In embodiments the costimulatory domain has at least 70%, 75%, 80%, 85%, 90%, 95%, 98%, or 99% sequence identity with the entire intracellular region, or a fragment of the intracellular region which is sufficient for generation of an intracellular signal, of a naturally occurring costimulatory molecule as described herein, e.g., a human, or other mammalian, e.g., a nonhuman species, e.g., rodent, monkey, ape or murine intracellular costimulatory molecule. In embodiments the costimulatory domain has at least 70%, 75%, 80%, 85%, 90%, 95%, 98%, or 99% sequence identity with SEQ ID NO: 14 or SEQ ID NO: 16.

In embodiments the costimulatory signaling domain has at least 70, 75, 80, 85, 90, 95, 96, 97, 98, or 99% identity with, or differs by no more than 30, 25, 20, 15, 10, 5, 4, 3, 2, or 1 amino acid residues from the corresponding residues of the entire intracellular region, or a fragment of the intracellular region which is sufficient for generation of an intracellular signal, of, a naturally occurring human costimulatory molecule, e.g., a naturally occurring human costimulatory molecule disclosed herein.

Any of the CARs described herein can include one or more of the components listed in Table 10.

TABLE 10

Sequences of various components of CAR (aa - amino acids, na - nucleic acids that encodes the corresponding protein)

| SEQ ID NO: | description | Sequence |
|---|---|---|
| 1 | EF-1 promoter | CGTGAGGCTCCGGTGCCCGTCAGTGGGCAGAGCGCACATCGCCCACAGTCC<br>CCGAGAAGTTGGGGGGAGGGGTCGGCAATTGAACCGGTGCCTAGAGAAGG<br>TGGCGCGGGGTAAACTGGGAAAGTGATGTCGTGTACTGGCTCCGCCTTTTTC<br>CCGAGGGTGGGGGAGAACCGTATATAAGTGCAGTAGTCGCCGTGAACGTTC<br>TTTTTCGCAACGGGTTTGCCGCCAGAACACAGGTAAGTGCCGTGTGTGGTTC<br>CCGCGGGCCTGGCCTCTTTACGGGTTATGGCCCTTGCGTGCCTTGAATTACTT<br>CCACCTGGCTGCAGTACGTGATTCTTGATCCCGAGCTTCGGGTTGGAAGTGG<br>GTGGGAGAGTTCGAGGCCTTGCGCTTAAGGAGCCCCTTCGCCTCGTGCTTGA<br>GTTGAGGCCTGGCCTGGGCGCTGGGGCCGCCGCGTGCGAATCTGGTGGCAC<br>CTTCGCGCCTGTCTCGCTGCTTTCGATAAGTCTCTAGCCATTTAAAATTTTGA<br>TGACCTGCTGCGACGCTTTTTTTCTGGCAAGATAGTCTTGTAAATGCGGGCC<br>AAGATCTGCACACTGGTATTTCGGTTTTTGGGGCCGCGGGCGGCGACGGGG<br>CCCGTGCGTCCCAGCGCACATGTTCGGCGAGGCGGGGCCTGCGAGCGCGGC<br>CACCGAGAATCGGACGGGGGTAGTCTCAAGCTGGCCGGCCTGCTCTGGTATG<br>CTGGCCTCGCGCCGCCGTGTATCGCCCCGCCCTGGGCGGCAAGGCTGGCCC<br>GGTCGGCACCAGTTGCGTGAGCGGAAAGATGGCCGCTTCCCGGCCCTGCTG<br>CAGGGAGCTCAAATGGAGGACGCGGCGCTCGGGAGAGCGGGCGGGTGA<br>GTCACCCACACAAAGGAAAAGGGCCTTTCCGTCCTCAGCCGTCGCTTCATGT<br>GACTCCACGGAGTACCGGGCGCCGTCCAGGCACCTCGATTAGTTCTCGAGCT<br>TTTGGAGTACGTCGTCTTTAGGTTGGGGGGAGGGGTTTTATGCGATGGAGT<br>TTCCCCACACTGAGTGGGTGGAGACTGAAGTTAGGCCAGCTTGGCACTTGAT<br>GTAATTCTCCTTGGAATTTGCCCTTTTTGAGTTTGGATCTTGGTTCATTCTCAA<br>GCCTCAGACAGTGGTTCAAAGTTTTTTTCTTCCATTTCAGGTGTCGTGA |
| 2 | Leader (aa) | MALPVTALLLPLALLLHAARP |
| 3 | Leader (na) | ATGGCCCTGCCTGTGACAGCCCTGCTGCTGCCTCTGGCTCTGCTGCTGCATGC<br>CGCTAGACCC |
| 4 | CD8 hinge (aa) | TTTPAPRPPTPAPTIASQPLSLRPEACRPAAGGAVHTRGLDFACD |
| 5 | CD8 hinge (na) | ACCACGACGCCAGCGCCGCGACCACCAACACCGGCGCCCACCATCGCGTCG<br>CAGCCCCTGTCCCTGCGCCCAGAGGCGTGCCGGCCAGCGGCGGGGGGCGCA<br>GTGCACACGAGGGGGCTGGACTTCGCCTGTGAT |
| 6 | Ig4 hinge (aa) | ESKYGPPCPPCPAPEFLGGPSVFLFPPKPKDTLMISRTPEVTCVVVDVSQEDPEV<br>QFNWYVDGVEVHNAKTKPREEQFNSTYRVVSVLTVLHQDWLNGKEYKCKVSN<br>KGLPSSIEKTISKAKGQPREPQVYTLPPSQEEMTKNQVSLTCLVKGFYPSDIAVE<br>WESNGQPENNYKTTPPVLDSDGSFFLYSRLTVDKSRWQEGNVFSCSVMHEALH<br>NHYTQKSLSLSLGKM |
| 7 | Ig4 hinge (na) | GAGAGCAAGTACGCCCTCCCTGCCCCCCTTGCCCTGCCCCCGAGTTCCTGG<br>GCGGACCCAGCGTGTTCCTGTTCCCCCCCAAGCCCAAGGACACCCTGATGAT<br>CAGCCGGACCCCCGAGGTGACCTGTGTGGTGGTGGACGTGTCCCAGGAGGA<br>CCCCGAGGTCCAGTTCAACTGGTACGTGGACGGCGTGGAGGTGCACAACGC<br>CAAGACCAAGCCCCGGGAGGAGCAGTTCAATAGCACCTACCGGGTGGTGTC<br>CGTGCTGACCGTGCTGCACCAGGACTGGCTGAACGGCAAGGAATACAAGTG<br>TAAGGTGTCCAACAAGGGCCTGCCCAGCAGCATCGAGAAAACCATCAGCAA<br>GGCCAAGGGCCAGCCTCGGGAGCCCCAGGTGTACACCCTGCCCCCTAGCCA<br>AGAGGAGATGACCAAGAACCAGGTGTCCCTGACCTGCCTGGTGAAGGGCTT<br>CTACCCCAGCGACATCGCCGTGGAGTGGGAGAGCAACGGCCAGCCCGAGAA<br>CAACTACAAGACCACCCCCCCTGTGCTGGACAGCGACGGCAGCTTCTTCCTG<br>TACAGCCGGCTGACCGTGGACAAGAGCCGGTGGCAGGAGGGCAACGTCTTT<br>AGCTGCTCCGTGATGCACGAGGCCCTGCACAACCACTACACCCAGAAGAGCC<br>TGAGCCTGTCCCTGGGCAAGATG |
| 8 | IgD hinge (aa) | RWPESPKAQASSVPTAQPQAEGSLAKATTAPATTRNTGRGGEEKKKEKEKEEQ<br>EERETKTPECPSHTQPLGVYLLTPAVQDLWLRDKATFTCFVVGSDLKDAHLTWE<br>VAGKVPTGGVEEGLLERHSNGSQSQHSRLTLPRSLWNAGTSVTCTLNHPSLPPQ<br>RLMALREPAAQAPVKLSLNLLASSDPPEAASWLLCEVSGFSPPNILLMWLEDQR<br>EVNTSGFAPARPPPQPGSTTFWAWSVLRVPAPPSPQPATYTCVVSHEDSRTLL<br>NASRSLEVSYVTDH |
| 9 | IgD hinge (na) | AGGTGGCCCGAAAGTCCCAAGGCCCAGGCATCTAGTGTTCCTACTGCACAGC<br>CCCAGGCAGAAGGCAGCCTAGCCAAAGCTACTACTGCACCTGCCACTACGCG<br>CAATACTGGCCGTGGCGGGAGGAGAAGAAAAAGGAGAAAGAGAAAGAA<br>GAACAGGAAGAGAGGGAGACCAAGACCCCTGAATGTCCATCCCATACCCAG<br>CCGCTGGGCGTCTATCTCTTGACTCCCGCAGTACAGGACTTGTGGCTTAGAG<br>ATAAGGCCACCTTTACATGTTTCGTCGTGGGCTCTGACCTGAAGGATGCCCA<br>TTTGACTTGGGAGGTTGCCGGAAAGGTACCCACAGGGGGGGTTGAGGAAG<br>GGTTGCTGGAGCGCCATTCCAATGGCTCTCAGAGCCAGCACTCAAGACTCAC<br>CCTTCCGAGATCCCTGTGGAACGCCGGGACCTCTGTCACATGTACTCTAAATC |

TABLE 10-continued

Sequences of various components of CAR (aa - amino acids, na - nucleic acids that encodes the corresponding protein)

| SEQ ID NO: | description | Sequence |
|---|---|---|
| | | ATCCTAGCCTGCCCCCACAGCGTCTGATGGCCCTTAGAGAGCCAGCCGCCCA GGCACCAGTTAAGCTTAGCCTGAATCTGCTCGCCAGTAGTGATCCCCCAGAG GCCGCCAGCTGGCTCTTATGCGAAGTGTCCGGCTTTAGCCCGCCCAACATCT TGCTCATGTGGCTGGAGGACCAGCGAGAAGTGAACACCAGCGGCTTCGCTC CAGCCCGGCCCCCACCCCAGCCGGGTTCTACCACATTCTGGGCCTGGAGTGT CTTAAGGGTCCCAGCACCACCTAGCCCCCAGCCAGCCACATACACCTGTGTT GTGTCCCATGAAGATAGCAGGACCCTGCTAAATGCTTCTAGGAGTCTGGAG GTTTCCTACGTGACTGACCATT |
| 10 | GS hinge/linker (aa) | GGGGSGGGGS |
| 11 | GS hinge/linker (na) | GGTGGCGGAGGTTCTGGAGGTGGAGGTTCC |
| 12 | CD8TM (aa) | IYIWAPLAGTCGVLLLSLVITLYC |
| 13 | CD8 TM (na) | ATCTACATCTGGGCGCCCTTGGCCGGGACTTGTGGGGTCCTTCTCCTGTCACT GGTTATCACCCTTTACTGC |
| 14 | 4-1BB intracellular domain (aa) | KRGRKKLLYIFKQPFMRPVQTTQEEDGCSCRFPEEEEGGCEL |
| 15 | 4-1BB intracellular domain (na) | AAACGGGGCAGAAAGAAACCTCTGTATATATTCAAACAACCATTTATGAGAC CAGTACAAACTACTCAAGAGGAAGATGGCTGTAGCTGCCGATTTCCAGAAG AAGAAGAAGGAGGATGTGAACTG |
| 16 | CD27 (aa) | QRRKYRSNKGESPVEPAEPCRYSCPREEEGSTIPIQEDYRKPEPACSP |
| 17 | CD27 (na) | AGGAGTAAGAGGAGCAGGCTCCTGCACAGTGACTACATGAACATGACTCCC CGCCGCCCCGGGCCCACCCGCAAGCATTACCAGCCCTATGCCCCACCACGCG ACTTCGCAGCCTATCGCTCC |
| 18 | CD3-zeta (aa) | RVKFSRSADAPAYKQGQNQLYNELNLGRREEYDVLDKRRGRDPEMGGKPRRK NPQEGLYNELQKDKMAEAYSEIGMKGERRRGKGHDGLYQGLSTATKDTYDAL HMQALPPR |
| 19 | CD3-zeta (na) | AGAGTGAAGTTCAGCAGGAGCGCAGACGCCCCCGCGTACAAGCAGGGCCA GAACCAGCTCTATAACGAGCTCAATCTAGGACGAAGAGAGGAGTACGATGT TTTGGACAAGAGACGTGGCCGGGACCCTGAGATGGGGGGAAAGCCGAGAA GGAAGAACCCTCAGGAAGGCCTGTACAATGAACTGCAGAAAGATAAGATGG CGGAGGCCTACAGTGAGATTGGGATGAAAGGCGAGCGCCGGAGGGGCAAG GGGCACGATGGCCTTTACCAGGGTCTCAGTACAGCCACCAAGGACACCTAC GACGCCCTTCACATGCAGGCCCTGCCCCCTCGC |
| 20 | CD3-zeta (aa) | RVKFSRSADAPAYQQGQNQLYNELNLGRREEYDVLDKRRGRDPEMGGKPRRK NPQEGLYNELQKDKMAEAYSEIGMKGERRRGKGHDGLYQGLSTATKDTYDAL HMQALPPR |
| 21 | CD3-zeta (na) | AGAGTGAAGTTCAGCAGGAGCGCAGACGCCCCCGCGTACCAGCAGGGCCA GAACCAGCTCTATAACGAGCTCAATCTAGGACGAAGAGAGGAGTACGATGT TTTGGACAAGAGACGTGGCCGGGACCCTGAGATGGGGGGAAAGCCGAGAA GGAAGAACCCTCAGGAAGGCCTGTACAATGAACTGCAGAAAGATAAGATGG CGGAGGCCTACAGTGAGATTGGGATGAAAGGCGAGCGCCGGAGGGGCAAG GGGCACGATGGCCTTTACCAGGGTCTCAGTACAGCCACCAAGGACACCTAC GACGCCCTTCACATGCAGGCCCTGCCCCCTCGC |
| 22 | linker | GGGGS |
| 23 | linker | GGTGGCGGAGGTTCTGGAGGTGGAGGTTCC |
| 28 | linker | (Gly-Gly-Gly-Ser)$_n$, where $_n$ =1-10 |
| 29 | linker | (Gly4 Ser)4 |
| 30 | linker | (Gly4 Ser)3 |
| 31 | linker | (Gly3Ser) |
| 32 | polyA | a(2000) |

TABLE 10-continued

Sequences of various components of CAR (aa - amino acids, na - nucleic acids that encodes the corresponding protein)

| SEQ ID NO: | description | Sequence |
|---|---|---|
| 33 | polyA | a(150) |
| 34 | polyA | a(5000) |
| 35 | polyT | t(100) |
| 36 | polyT | t(5000) |
| 37 | polyA | a(1000) |
| 38 | polyA | a(400) |

Co-Expression of CAR with Other Molecules or Agents

Co-Expression of a Second CAR

In one aspect, the CAR-expressing cell described herein can further comprise a second CAR, e.g., a second CAR that includes a different antigen binding domain, e.g., to the same target (e.g., CD19) or a different target (e.g., a target other than CD19, e.g., a target described herein). In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. Placement of a costimulatory signaling domain, e.g., 4-1BB, CD28, CD27, OX-40 or ICOS, onto the first CAR, and the primary signaling domain, e.g., CD3 zeta, on the second CAR can limit the CAR activity to cells where both targets are expressed. In one embodiment, the CAR expressing cell comprises a first CAR that includes an antigen binding domain, a transmembrane domain and a costimulatory domain and a second CAR that targets another antigen and includes an antigen binding domain, a transmembrane domain and a primary signaling domain. In another embodiment, the CAR expressing cell comprises a first CAR that includes an antigen binding domain, a transmembrane domain and a primary signaling domain and a second CAR that targets another antigen and includes an antigen binding domain to the antigen, a transmembrane domain and a costimulatory signaling domain.

In one embodiment, the CAR-expressing cell comprises an XCAR described herein and an inhibitory CAR. In one embodiment, the inhibitory CAR comprises an antigen binding domain that binds an antigen found on normal cells but not cancer cells, e.g., normal cells that also express X. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (CEACAM-1, CEACAM-3, and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGF (e.g., TGFbeta).

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

In some embodiments, the antigen binding domain comprises a single domain antigen binding (SDAB) molecules. SDAB molecules include molecules whose complementary determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, lamprey, fish, shark, goat, rabbit, and bovine. This term also includes naturally occurring single domain antibody molecules from species other than Camelidae and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. et al. (1993) Nature 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from Camelidae species, for example in camel, llama, dromedary, alpaca and guanaco. Other species besides Camelidae may produce heavy chain molecules naturally devoid of light chain; such VHHs are within the scope of the invention.

The SDAB molecules can be recombinant, CDR-grafted, humanized, camelized, de-immunized and/or in vitro generated (e.g., selected by phage display).

It has also been discovered, that cells having a plurality of chimeric membrane embedded receptors comprising an antigen binding domain that interactions between the antigen binding domain of the receptors can be undesirable, e.g., because it inhibits the ability of one or more of the antigen binding domains to bind its cognate antigen. Accordingly, disclosed herein are cells having a first and a second non-naturally occurring chimeric membrane embedded receptor comprising antigen binding domains that minimize such interactions. Also disclosed herein are nucleic acids encoding a first and a second non-naturally occurring chimeric membrane embedded receptor comprising an antigen binding domains that minimize such interactions, as well as methods of making and using such cells and nucleic acids. In an embodiment the antigen binding domain of one of the first and the second non-naturally occurring chimeric membrane embedded receptor, comprises an scFv, and the other comprises a single VH domain, e.g., a camelid, shark, or lamprey single VH domain, or a single VH domain derived from a human or mouse sequence.

In some embodiments, a composition herein comprises a first and second CAR, wherein the antigen binding domain of one of the first and the second CAR does not comprise a variable light domain and a variable heavy domain. In some embodiments, the antigen binding domain of one of the first and the second CAR is an scFv, and the other is not an scFv. In some embodiments, the antigen binding domain of one of the first and the second CAR comprises a single VH domain, e.g., a camelid, shark, or lamprey single VH domain, or a single VH domain derived from a human or mouse sequence. In some embodiments, the antigen binding domain of one of the first and the second CAR comprises a nanobody. In some embodiments, the antigen binding domain of one of the first and the second CAR comprises a camelid VHH domain.

In some embodiments, the antigen binding domain of one of the first and the second CAR comprises an scFv, and the other comprises a single VH domain, e.g., a camelid, shark, or lamprey single VH domain, or a single VH domain derived from a human or mouse sequence. In some embodiments, the antigen binding domain of one of the first and the second CAR comprises an scFv, and the other comprises a nanobody. In some embodiments, the antigen binding domain of one of the first and the second CAR comprises an scFv, and the other comprises a camelid VHH domain.

In some embodiments, when present on the surface of a cell, binding of the antigen binding domain of the first CAR to its cognate antigen is not substantially reduced by the presence of the second CAR. In some embodiments, binding of the antigen binding domain of the first CAR to its cognate antigen in the presence of the second CAR is 85%, 90%, 95%, 96%, 97%, 98% or 99% of binding of the antigen binding domain of the first CAR to its cognate antigen in the absence of the second CAR.

In some embodiments, when present on the surface of a cell, the antigen binding domains of the first and the second CAR, associate with one another less than if both were scFv antigen binding domains. In some embodiments, the antigen binding domains of the first and the second CAR, associate with one another 85%, 90%, 95%, 96%, 97%, 98% or 99% less than if both were scFv antigen binding domains.

Co-Expression of an Agent that Enhances CAR Activity

In another aspect, the CAR-expressing cell described herein can further express another agent, e.g., an agent that enhances the activity or fitness of a CAR-expressing cell.

For example, in one embodiment, the agent can be an agent which inhibits a molecule that modulates or regulates, e.g., inhibits, T cell function. In some embodiments, the molecule that modulates or regulates T cell function is an inhibitory molecule. Inhibitory molecules, e.g., PD1, can, in some embodiments, decrease the ability of a CAR-expressing cell to mount an immune effector response. Examples of inhibitory molecules include PD1, PD-L1, CTLA4, TIM3, LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, or TGF beta.

In embodiments, an agent, e.g., an inhibitory nucleic acid, e.g., a dsRNA, e.g., an siRNA or shRNA; or e.g., an inhibitory protein or system, e.g., a clustered regularly interspaced short palindromic repeats (CRISPR), a transcription-activator like effector nuclease (TALEN), or a zinc finger endonuclease (ZFN), e.g., as described herein, can be used to inhibit expression of a molecule that modulates or regulates, e.g., inhibits, T-cell function in the CAR-expressing cell. In an embodiment the agent is an shRNA, e.g., an shRNA described herein. In an embodiment, the agent that modulates or regulates, e.g., inhibits, T-cell function is inhibited within a CAR-expressing cell. For example, a dsRNA molecule that inhibits expression of a molecule that modulates or regulates, e.g., inhibits, T-cell function is linked to the nucleic acid that encodes a component, e.g., all of the components, of the CAR.

In one embodiment, the agent that inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, or TGF beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1), can be fused to a transmembrane domain and intracellular signaling domains such as 41BB and CD3 zeta (also referred to herein as a PD1 CAR). In one embodiment, the PD1 CAR, when used in combinations with an XCAR described herein, improves the persistence of the T cell. In one embodiment, the CAR is a PD1 CAR comprising the extracellular domain of PD1 indicated as underlined in SEQ ID NO: 40. In one embodiment, the PD1 CAR comprises the amino acid sequence of SEQ ID NO:40.

In one embodiment, the agent comprises a nucleic acid sequence encoding the PD1 CAR, e.g., the PD1 CAR described herein. In one embodiment, the nucleic acid sequence for the PD1 CAR is shown in SEQ ID NO: 42, with the PD1 ECD underlined in SEQ ID NO: 42.

In another example, in one embodiment, the agent that enhances the activity of a CAR-expressing cell can be a costimulatory molecule or costimulatory molecule ligand. Examples of costimulatory molecules include MHC class I molecule, BTLA and a Toll ligand receptor, as well as OX40, CD27, CD28, CDS, ICAM-1, LFA-1 (CD11a/CD18), ICOS (CD278), and 4-1BB (CD137). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83., e.g., as described herein. Examples of costimulatory molecule ligands include CD80, CD86, CD40L, ICOSL, CD70, OX40L, 4-1BBL, GITRL, and LIGHT. In embodiments, the costimulatory molecule ligand is a ligand for a costimulatory molecule different from the costimulatory molecule domain of the CAR. In embodiments, the costimulatory molecule ligand is a ligand for a costimulatory molecule that is the same as the costimulatory molecule domain of the CAR. In an embodiment, the costimulatory molecule ligand is 4-1BBL. In an embodiment, the costimulatory ligand is CD80 or CD86. In an embodiment, the costimulatory molecule ligand is CD70. In embodiments, a CAR-expressing immune effector cell described herein can be further engineered to express one or more additional costimulatory molecules or costimulatory molecule ligands.

Co-Expression of CAR with a Chemokine Receptor

In embodiments, the CAR-expressing cell described herein, e.g., CD19 CAR-expressing cell, further comprises a chemokine receptor molecule. Transgenic expression of chemokine receptors CCR2b or CXCR2 in T cells enhances trafficking to CCL2- or CXCL1-secreting solid tumors including melanoma and neuroblastoma (Craddock et al., *J Immunother.* 2010 October; 33(8):780-8 and Kershaw et al., *Hum Gene Ther.* 2002 Nov. 1; 13(16):1971-80). Thus, without wishing to be bound by theory, it is believed that chemokine receptors expressed in CAR-expressing cells that recognize chemokines secreted by tumors, e.g., solid tumors, can improve homing of the CAR-expressing cell to the tumor, facilitate the infiltration of the CAR-expressing cell to the tumor, and enhances antitumor efficacy of the CAR-expressing cell. The chemokine receptor molecule can comprise a naturally occurring or recombinant chemokine receptor or a chemokine-binding fragment thereof. A chemokine receptor molecule suitable for expression in a CAR-expressing cell (e.g., CAR-Tx) described herein include a CXC chemokine receptor (e.g., CXCR1, CXCR2, CXCR3, CXCR4, CXCR5, CXCR6, or CXCR7), a CC chemokine receptor (e.g., CCR1, CCR2, CCR3, CCR4, CCR5, CCR6, CCR7, CCR8, CCR9, CCR10, or CCR11), a CX3C chemokine receptor (e.g., CX3CR1), a XC chemokine receptor (e.g., XCR1), or a chemokine-binding fragment thereof. In one embodiment, the chemokine receptor molecule to be expressed with a CAR described herein is selected based on the chemokine(s) secreted by the tumor. In one embodiment, the CAR-expressing cell described herein further comprises, e.g., expresses, a CCR2b receptor or a CXCR2 receptor. In an embodiment, the CAR described herein and the chemokine receptor molecule are on the same vector or are on two different vectors. In embodiments where the CAR described herein and the chemokine receptor molecule are on the same vector, the CAR and the chemokine receptor molecule are each under control of two different promoters or are under the control of the same promoter.

CAR-Expressing Cells

The CARs described herein are expressed on cells, e.g., immune effector cells, e.g., T cells. For example, a nucleic acid construct of a CAR described herein is transduced to a T cell. In embodiments, the cells expressing the CARs described herein are an in vitro transcribed RNA CAR T cell.

Sources of Cells

In embodiments, prior to expansion and genetic modification or other modification, a source of cells, e.g., T cells or natural killer (NK) cells, can be obtained from a subject. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In embodiments, immune effector cells (e.g., a population of immune effector cells), e.g., T cells, are derived from (e.g., differentiated from) a stem cell, e.g., an embryonic stem cell or a pluripotent stem cell, e.g., an induced pluripotent stem cell (iPSC). In embodiments, the cells are autologous or allogeneic. In embodiments wherein the cells are allogeneic, the cells, e.g., derived from stem cells (e.g., iPSCs), are modified to reduce their alloreactivity. For example, the cells can be modified to reduce alloreactivity, e.g., by modifying (e.g., disrupting) their T cell receptor. In embodiments, a site specific nuclease can be used to disrupt the T cell receptor, e.g., after T-cell differentiation. In other examples, cells, e.g., T cells derived from iPSCs, can be generated from virus-specific T cells, which are less likely to cause graft-versus-host disease because of their recognition of a pathogen-derived antigen. In yet other examples, alloreactivity can be reduced, e.g., minimized, by generating iPSCs from common HLA haplotypes such that they are histocompatible with matched, unrelated recipient subjects. In yet other examples, alloreactivity can be reduced, e.g., minimized, by repressing HLA expression through genetic modification. For example, T cells derived from iPSCs can be processed as described in, e.g., Themeli et al. *Nat. Biotechnol.* 31.10(2013):928-35, incorporated herein by reference. In some examples, immune effector cells, e.g., T cells, derived from stem cells, can be processed/generated using methods described in WO2014/165707, incorporated herein by reference. Additional embodiments pertaining to allogeneic cells are described herein, e.g., in the "Allogeneic CAR Immune Effector Cells" section herein.

In embodiments, the methods, e.g., manufacturing methods, further comprise contacting with IL-15 and/or IL-7, a cell population. For example, the cell population is expanded in the presence of IL-15 and/or IL-7. In embodiments, the cell population is treated as described on p. 145 of International Application WO2016/109410, which application is herein incorporated by reference in its entirety.

T Cells

In an embodiment, the cells are T cells. T cell lines available in the art may be used. In embodiments, T cells can be obtained from a unit of blood collected from a subject using any number of techniques known to the skilled artisan, such as Ficoll™ separation. In an embodiment, cells from the circulating blood of an individual are obtained by apheresis. The apheresis product typically contains lymphocytes, including T cells, monocytes, granulocytes, B cells, other nucleated white blood cells, red blood cells, and platelets. In an embodiment, the cells collected by apheresis may be washed to remove the plasma fraction and to place the cells in an appropriate buffer or media for subsequent processing steps. In an embodiment, the cells are washed with phosphate buffered saline (PBS). In an alternative embodiment, the wash solution lacks calcium and may lack magnesium or may lack many if not all divalent cations. In an embodiment, the initial activation steps in the absence of calcium lead to magnified signal activation. A washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

In an embodiment, T cells are isolated from peripheral blood lymphocytes by lysing the red blood cells and depleting the monocytes, for example, by centrifugation through a PERCOLL™ gradient or by counterflow centrifugal elutriation. A specific subpopulation of T cells, such as CD3+, CD28+, CD4+, CD8+, CD45RA+, and CD45RO+ T cells, can be further isolated by positive or negative selection techniques. For example, in an embodiment, T cells are isolated by incubation with anti-CD3/anti-CD28 (i.e., 3×28)-conjugated beads, such as DYNABEADS® M-450 CD3/CD28 T, for a time period sufficient for positive selection of the desired T cells. In an embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another embodiment, the time period is 10 to 24 hours. In an embodiment, the incubation time period is 24 hours. For isolation of T cells from patients with leukemia, use of longer incubation times, such as 24 hours, can increase cell yield. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points. The skilled artisan would recognize that multiple rounds of selection can also be used. In certain embodiments, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD11b, CD16, HLA-DR, and CD8. In certain embodiments, it may be desirable to enrich for or positively select for regulatory T cells which typically express CD4+, CD25+, CD62Lhi, GITR+, and FoxP3+. Alternatively, in certain embodiments, T regulatory cells are depleted by anti-CD25 conjugated beads or other similar method of selection. Methods of decreasing $T_{REG}$ cells include, but are not limited to, cyclophosphamide, anti-GITR antibody, CD25-depletion, mTOR inhibitor, and combinations thereof. In embodiments, $T_{REG}$ cells are depleted, e.g., as described in International Application WO2016/109410 filed Dec. 28, 2015 (e.g., on pages 1-6 and 152-153 therein), which application is herein incorporated by reference in its entirety.

In embodiments, the cells, e.g., T cells, ectopically expresses a telomerase subunit, e.g., the catalytic subunit of telomerase, e.g., TERT, e.g., hTERT, e.g., as described in pages 62-66 of International Application WO2016/109410 filed Dec. 28, 2015, which application is herein incorporated by reference in its entirety.

For isolation of a desired population of cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads. In an embodiment, a concentration of 2 billion cells/ml is used. In an embodiment, a concentration of 1 billion cells/ml is used. In a further embodiment, greater than 100 million cells/ml is used. In a further embodiment, a concentration of cells of 10, 15, 20, 25, 30, 35, 40, 45, or 50 million cells/ml is used. In an embodiment, a concentration of cells from 75, 80, 85, 90, 95, or 100 million cells/ml is used. In further embodiments, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (i.e., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related embodiment it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In an embodiment, the concentration of cells used is $5 \times 10^6$/ml. In other embodiments, the concentration used can be from about $1 \times 10^5$/ml to $1 \times 10^6$/ml, and any integer value in between. In other embodiments, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain embodiments, cryopreserved cells are thawed and washed as described herein and allowed to rest for one hour at room temperature prior to activation using the methods described herein.

In an embodiment the collection of blood samples or apheresis product from a subject is made at a time period prior to when the expanded cells might be needed. As such, the source of the cells to be expanded can be collected at any time point necessary, and desired cells, such as T cells, isolated and frozen for later use in, e.g., T cell therapy for any number of diseases or conditions that would benefit from such T cell therapy. In an embodiment a blood sample or an apheresis is taken from a generally healthy subject. In certain embodiments, a blood sample or an apheresis is taken from a generally healthy subject who is at risk of developing a disease, but who has not yet developed a disease, and the cells of interest are isolated and frozen for later use. In certain embodiments, the T cells may be expanded, frozen, and used at a later time. In certain embodiments, samples are collected from a patient shortly after diagnosis of a particular disease but prior to any treatments. In a further embodiment, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation. These drugs inhibit either the calcium dependent phosphatase calcineurin (cyclosporine and FK506) or inhibit the p70S6 kinase that is important for growth factor induced signalling (rapamycin). (Liu et al., Cell 66:807-815, 1991; Henderson et al., Immun. 73:316-321, 1991; Bierer et al., Curr. Opin. Immun. 5:763-773, 1993). In a further embodiment, the cells are isolated for a patient and frozen for later use in conjunction with (e.g., before, simultaneously or following) bone marrow or stem cell transplantation, T cell ablative therapy using either chemotherapy agents such as, fludarabine, external-beam radiation therapy (XRT), cyclophosphamide, or antibodies such as OKT3 or CAMPATH. In an embodiment, the cells are isolated prior to and can be frozen for later use for treatment following B-cell ablative therapy such as agents that react with CD20, e.g., Rituxan.

In a further embodiment, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain embodiments, mobilization (for example, mobilization with GM-CSF) and conditioning regimens can be used to create a condition in a subject wherein repopulation, recirculation, regeneration, and/or expansion of particular cell types is favored, especially during a defined window of time following therapy.

Allogeneic CAR

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta), or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some embodiments, downregulation of HLA may be accomplished by reducing or eliminating expression of beta-2 microglobulin (B2M).

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN). In some embodiments, the allogenic cell can be a cell which does not expresses or expresses at low levels an inhibitory molecule, e.g. by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, PD-L2, CTLA4, TIM3, LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGF (e.g., TGF beta). Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR and/or HLA and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

Expression systems for siRNA and shRNAs, and exemplary shRNAs, are described, e.g., in paragraphs 649 and 650 of International Application WO2015/142675, filed Mar. 13, 2015, which is incorporated by reference in its entirety.

CRISPR to Inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

The CRISPR/Cas system, and uses thereof, are described, e.g., in paragraphs 651-658 of International Application WO2015/142675, filed Mar. 13, 2015, which is incorporated by reference in its entirety.

TALEN to Inhibit TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

TALENs, and uses thereof, are described, e.g., in paragraphs 659-665 of International Application WO2015/142675, filed Mar. 13, 2015, which is incorporated by reference in its entirety.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGF beta), in a cell, e.g., T cell.

ZFNs, and uses thereof, are described, e.g., in paragraphs 666-671 of International Application WO2015/142675, filed Mar. 13, 2015, which is incorporated by reference in its entirety.

NK Cells

In an embodiment, the cells are natural killer cells. These cells can be isolated from patients. In an embodiment, the cells are stable cell lines of natural killer cells, e.g., a stable allogeneic NK-92 cell line available, from Conkwest. These stable NK-92 cell lines were derived from NK-92 cells that were obtained, transfected and cultured using the methods described by Gong et al (April 1994), Leukemia Macmillan Press, Ltd, 8: 652-658, and disclosed in EP1007630, incorporated herein by reference. An NK cell line with properties similar to the NK-92 cell line can also be used. In an embodiment, NK cells from the circulating blood of an individual are obtained by apheresis. In an embodiment, NK cells are engineered to express a CAR, and these engineered CARN cells can be used to treat a patient other than a patient from whom the NK cells were isolated. Hence, these CARN cells are "universal" cells in that can be administered to multiple patients without adverse effects. That is to say that NK cells can be isolated from one patient and engineered to express a CAR, thereby producing CARN cells, and these CARN cells can then be administered to the same or different patient. NK cells, e.g., NK-92 cells, do not express killer inhibitory receptors, and therefore cannot be inactivated by evading cancer cells. Methods for isolation and use of NK cells (e.g., NK-92 cell lines or similar NK cell lines derived from peripheral blood mononuclear cells from a patient with non-Hodgkins lymphoma) have been described (See Zhang et al (2013) Retargeting NK-92 for anti-melanoma activity by a TCR-like single domain antibody; Immunol Cell Biol. 91: 615-6249 Tonn et al. (2013) Treatment of patients with advanced cancer with the natural killer cell-line NK-92, Cytotherapy, 15: 1563-1570.

The NK-92 cell line was found to exhibit the $CD56^{high}$, CD2, CD7, CD11a, CD28, CD45, and CD54 surface markers. It furthermore does not display the CD1, CD3, CD4, CD5, CD8, CD10, CD14, CD 16, CD19, CD20, CD23, and CD34 markers. Growth of NK-92 cells in culture is dependent upon the presence of recombinant interieukin 2 (rIL-2), with a dose as low as 10 IU/mL being sufficient to maintain proliferation. NK cell lines with similar properties can also be used.

NK-92 cells are readily maintained in culture medium, such as enriched alpha minimum essential medium (MEM, Sigma Chemical Co. St Louis, Mo.) supplemented with fetal calf serum (for example, at 12 5%, Sigma Chemical Co., St Louis, Mo.), and horse serum (for example, at 12.5%, (Sigma Chemical Co., St Louis, Mo.). Initially, 10M hydrocortisone is required, but in subsequent passages it is found that hydrocortisone may be omitted. In addition, IL-2, such as recombinant human IL-2 (500 U/mL, Chiron, Emeryville, Calif.), is required for long-term growth. When suspension cultures are maintained in this fashion with semiweekly changes of medium, the cells exhibit a doubling time of about 24 h.

NK-92 cells in vitro demonstrate lytic activity against a broad range of malignant target cells. These include cell lines derived from circulating target cells such as acute and chronic lymphoblastic and myelogenous leukemia, lymphoma, myeloma, melanoma, as well as cells from solid tumors such as prostate cancer, neuroblastoma, and breast cancer cell lines.

Other Immune Effector Cells

Figure 8:
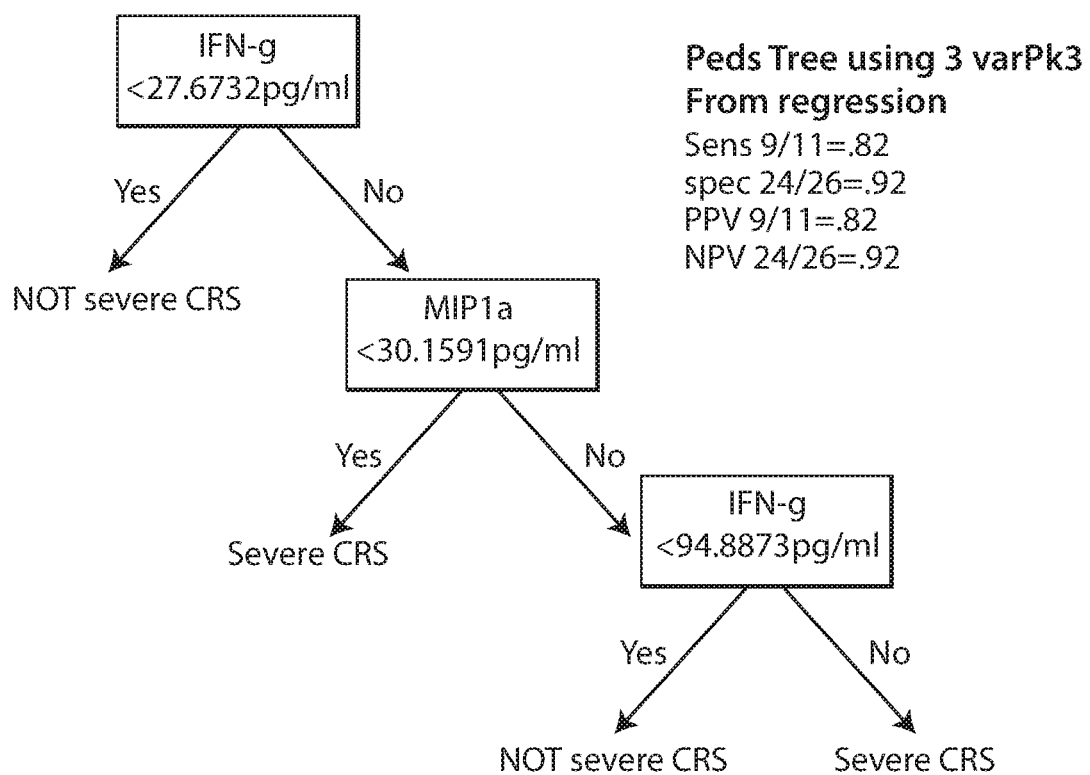
FIG. 8 depicts a decision tree that can be used when evaluating a panel comprising IFN-gamma (at two steps) and MIP1a, e.g., in pediatric patients. The sensitivity, specificity, PPV, and NPV of this decision tree are indicated. In the pediatric cohort only, a bone marrow aspirate was collected immediately prior to infusion. It was found that disease burden was associated with CRS severity but did not improve the predictive accuracy of the models over the cytokines alone.

In another embodiment, any number of immune effector cells may be isolated and engineered to express CARs, e.g., B cell, mast cells. Myeloid derived phagocytes, NKT cells, or γδT cells. Exemplary immune effector cells are listed in FIG. 8 of International Application WO2015/090229, which application is herein incorporated by reference in its entirety.

Activation and Expansion of T Cells

In an embodiment, the immune effector cell is a T cell. T cells are activated and expanded generally using methods as described, for example, in U.S. Pat. Nos. 6,352,694; 6,534, 055; 6,905,680; 6,692,964; 5,858,358; 6,887,466; 6,905, 681; 7,144,575; 7,067,318; 7,172,869; 7,232,566; 7,175, 843; 5,883,223; 6,905,874; 6,797,514; 6,867,041; and U.S. Patent Application Publication No. 20060121005.

In an embodiment, the T cells are expanded by contact with a surface having attached thereto an agent that stimulates a CD3/TCR complex associated signal and a ligand that stimulates a costimulatory molecule on the surface of the T cells. In a T cell a costimulatory molecule is a binding partner on a T cell that binds to a costimulatory ligand, mediating a costimulatory response in the T cell, i.e., an MHC class I molecule, e.g., CD28. In particular, T cell populations may be stimulated as described herein, e.g., by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For stimulation of an accessory molecule (e.g., CD3) on the surface of the T cells, a ligand that binds the accessory molecule is used. A population of T cells can be expanded with an anti-CD3 antibody and an anti-CD28 antibody under conditions appropriate for stimulating proliferation of the T cells. To stimulate proliferation of either CD4+ T cells or CD8+ T cells, an anti-CD3 antibody and an anti-CD28 antibody would be used. Examples of an anti-CD28 antibody include 9.3, B-T3, XR-CD28 (Diaclone, Besancon, France; (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In certain embodiments, the primary activation signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In an embodiment, the agent providing the costimulatory signal is bound to a cell surface and the agent providing the primary activation signal is in solution or coupled to a surface. In certain embodiments, both agents can be in solution. In an embodiment, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells.

In an embodiment, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In an embodiment, a 1:1 ratio of each antibody bound to the beads for CD4+ T cell expansion and T cell growth is used. In certain embodiments, a ratio of anti CD3:CD28 antibodies bound to the beads is used such that an increase in T cell expansion is observed as compared to the expansion observed using a ratio of 1:1. In an embodiment an increase of from about 1 to about 3 fold is observed as compared to the expansion observed using a ratio of 1:1. In an embodiment, the ratio of CD3:CD28 antibody bound to the beads ranges from 100:1 to 1:100 and all integer values there between. In an embodiment, more anti-CD28 antibody is bound to the particles than anti-CD3 antibody, i.e., the ratio of CD3:CD28 is less than one. In certain embodiments, the ratio of anti CD28 antibody to anti CD3 antibody bound to the beads is greater than 2:1. In an embodiment, a 1:100 CD3:CD28 ratio of antibody bound to beads is used. In an embodiment, a 1:75 CD3:CD28 ratio of antibody bound to beads is used. In a further embodiment, a 1:50 CD3:CD28 ratio of antibody bound to beads is used. In an embodiment, a 1:30 CD3:CD28 ratio of antibody bound to beads is used. In an embodiment, a 1:10 CD3: CD28 ratio of antibody bound to beads is used. In another embodiment, a 1:3 CD3:CD28 ratio of antibody bound to the beads is used. In yet another embodiment, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain embodiments the ratio of cells to particles ranges from 1:100 to 100:1 and any integer values in-between and in further embodiments the ratio comprises 1:9 to 9:1 and any integer values in between, can also be used to stimulate T cells. The ratio of anti-CD3- and anti-CD28-coupled particles to T cells that result in T cell stimulation can vary as noted above, however certain suitable values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one suitable ratio being at least 1:1 particles per T cell. In an embodiment, a ratio of particles to cells of 1:1 or less is used. In one particular embodiment, a suitable particle:cell ratio is 1:5. In further embodiments, the ratio of particles to cells can be varied depending on the day of stimulation. For example, in an embodiment, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular embodiment, the ratio of particles to cells is 1:1 on the first day of stimulation and adjusted to 1:5 on the third and fifth days of stimulation. In an embodiment, particles are added on a daily or every other day basis to a final ratio of 1:1 on the first day, and 1:5 on the third and fifth days of stimulation. In an embodiment, the ratio of particles to cells is 2:1 on the first day of stimulation and adjusted to 1:10 on the third and fifth days of stimulation. In an embodiment, particles are added on a daily or every other day basis to a final ratio of 1:1 on the first day, and 1:10 on the third and fifth days of stimulation. One of skill in the art will appreciate that a variety of other ratios may be suitable for use. In particular, ratios will vary depending on particle size and on cell size and type. In an embodiment, the most typical ratios for use are in the neighborhood of 1:1, 2:1 and 3:1 on the first day.

In further embodiments, the cells, e.g., T cells, are combined with agent-coated beads, the beads and the cells are subsequently separated, and then the cells are cultured. In an alternative embodiment, prior to culture, the agent-coated beads and cells are not separated but are cultured together. In a further embodiment, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In an embodiment the cells (e.g., $10^4$ to $10^9$ T cells) and beads (e.g., DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. In certain embodiments, it may be desirable to significantly decrease the volume in which particles and cells are mixed together (i.e., increase the concentration of cells), to ensure maximum contact of cells and particles. For example, in an embodiment, a concentration of about 2 billion cells/ml is used. In an embodiment, greater than 100 million cells/ml is used. In a further embodiment, a concentration of cells of 10, 15, 20, 25, 30, 35, 40, 45, or 50 million cells/ml is used. In yet an embodiment, a concentration of cells from 75, 80, 85, 90, 95, or 100 million cells/ml is used. In further embodiments, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain embodiments. For example, using high concentration of cells allows more efficient selection of CD8+ T cells that normally have weaker CD28 expression.

In an embodiment, the mixture may be cultured for several hours (about 3 hours) to about 14 days or any hourly integer value in between. In an embodiment, the mixture may be cultured for 21 days. In an embodiment the beads and the T cells are cultured together for about eight days. In an embodiment, the beads and T cells are cultured together for 2-3 days. Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth for example, an appropriate temperature (e.g., 37° C.) and atmosphere (e.g., air plus 5% $CO_2$).

T cells that have been exposed to varied stimulation times may exhibit different characteristics. For example, typical blood or apheresed peripheral blood mononuclear cell products have a helper T cell population ($T_H$, CD4+) that is greater than the cytotoxic or suppressor T cell population ($T_C$, CD8+). Ex vivo expansion of T cells by stimulating CD3 and CD28 receptors produces a population of T cells that prior to about days 8-9 consists predominately of $T_H$ cells, while after about days 8-9, the population of T cells comprises an increasingly greater population of $T_C$ cells. Accordingly, depending on the purpose of treatment, infusing a subject with a T cell population comprising predominately of $T_H$ cells may be advantageous. Similarly, if an antigen-specific subset of $T_C$ cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Various assays can be used to evaluate the activity of the CAR molecule, such as but not limited to, the ability to expand T cells following antigen stimulation, sustain T cell expansion in the absence of re-stimulation, and anti-cancer activities in appropriate animal models. Assays to evaluate the effects of the CAR, are described in further detail below Western blot analysis of CAR expression in primary T cells can be used to detect their presence using published methods for CARs. See, e.g., Milone et al., Molecular Therapy 17(8): 1453-1464 (2009). Very briefly, T cells (1:1 mixture of CD4$^+$ and CD8$^+$ T cells) expressing the CARs are expanded in vitro for more than 10 days followed by lysis and SDS-PAGE under reducing conditions. CARs containing the full length TCR-t cytoplasmic domain and the endogenous TCR-t chain are detected by western blotting using an antibody to the TCR-t chain. The same T cell subsets are used for SDS-PAGE analysis under non-reducing conditions to permit evaluation of covalent dimer formation.

In vitro expansion of CAR$^+$ T cells (i.e., CART cells) following antigen stimulation can be measured by flow cytometry. For example, a mixture of CD4$^+$ and CD8$^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the CD4$^+$ and/or CD8$^+$ T cell subsets by flow cytometry. See, e.g., Milone et al., Molecular Therapy 17(8): 1453-1464 (2009). Alternatively, a mixture of CD4+ and CD8+ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with CAR constructs in the presence of antiCD3 and anti-CD28 antibody (K562-BBL-3/28) following washing. Exogenous IL-2 is added to the cultures every other day at 100 IU/ml. GFP+ T cells are enumerated by flow cytometry using bead-based counting. See, e.g., Milone et al., Molecular Therapy 17(8): 1453-1464 (2009).

Sustained CAR+ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter following stimulation with αCD3/αCD28 coated magnetic beads on day 0, and transduction with the indicated RCAR on day 1.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with target cells, such as U87MG, BHK or CHO cells expressing a tumor antigen, e.g., EGFRvIII or EGFR wildtype (wt) or CD32 and CD137 (KT32-BBL) for a final T-cell:target cell ratio of 1:1. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8+ T cell expansion ex vivo. T cells are enumerated in cultures using CountBright™ fluorescent beads (Invitrogen, Carlsbad, Calif.) and flow cytometry as described by the manufacturer. CAR+ T cells are identified by GFP expression using T cells that are engineered with eGFP-2A linked CAR-expressing lentiviral vectors. For CAR+ T cells not expressing GFP, the CAR+ T cells are detected with biotinylated recombinant protein, e.g., EGFRvIII and a secondary avidin-PE conjugate. CD4+ and CD8+ expression on T cells are also simultaneously detected with specific monoclonal antibodies (BD Biosciences). Cytokine measurements are performed on supernatants collected 24 hours following re-stimulation with the human TH1/TH2 cytokine cytometric bead array kit (BD Biosciences, San Diego, Calif.) according the manufacturer's instructions. Fluorescence is assessed using a FACScalibur flow cytometer, and data is analyzed according to the manufacturer's instructions.

Cytotoxicity can be assessed by a standard $^{51}$Cr-release assay. See, e.g., Milone et al., Molecular Therapy 17(8): 1453-1464 (2009). Briefly, target cells (e.g., U87MG, BHK or CHO cells expressing RCAR, e.g., EGFRvIII or EGFR wildtype (wt) are loaded with $^{51}$Cr (as NaCrO$_4$, New England Nuclear, Boston, Mass.) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released $^{51}$Cr is then measured using a gamma particle counter (Packard Instrument Co., Waltham, Mass.). Each condition is performed in at least triplicate, and the percentage of lysis is calculated using the formula: % Lysis=(ER−SR)/(TR−SR), where ER represents the average $^{51}$Cr released for each experimental condition. Alternative cytotoxicity assays may also be used, such as flow based cytotoxicity assays. Other assays, including those described in the Example section herein as well as those that are known in the art can also be used to evaluate the RCAR constructs.

Nucleic Acid Constructs Encoding a CAR

Nucleic acid molecules encoding one or more CAR constructs can be introduced into an immune effector cell (e.g., a T cell) as described herein. In one aspect, the nucleic acid molecule is provided as a messenger RNA transcript. In one aspect, the nucleic acid molecule is provided as a DNA construct.

The nucleic acid molecules described herein can be a DNA molecule, an RNA molecule, or a combination thereof. In one embodiment, the nucleic acid molecule is an mRNA encoding a CAR polypeptide as described herein. In other embodiments, the nucleic acid molecule is a vector that includes any of the aforesaid nucleic acid molecules.

Nucleic acid molecules can encode, e.g., a CAR molecule described herein, and can comprise, e.g., a nucleic acid sequence described herein, e.g., in Table 1, Table 2 or Table 3.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

Also described are vectors in which a nucleic acid of the present disclosure is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, CRISPR, CAS9, and zinc finger nucleases. See below June et al. 2009 Nature Reviews Immunology 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription. Exemplary promoters include the CMV IE gene, EF-1a, ubiquitin C, or phosphoglycerokinase (PGK) promoters.

An example of a promoter that is capable of expressing a CAR transgene in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from transgenes cloned into a lentiviral vector. See, e.g., Milone et al., MOL. THER. 17(8): 1453-1464 (2009). In one aspect, the EF1a promoter comprises the sequence provided as SEQ ID NO:11.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. In embodiments, the truncated PGK promoter is one described in International Application WO2016/115482 filed Jan. 15, 2016 (e.g., on pages 43-44 therein), which application is hereby incorporated by reference in its entirety.

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS LETTERS 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In embodiments, the vector may comprise two or more nucleic acid sequences encoding a CAR, e.g., a CAR described herein, e.g., a CD19 CAR, and a second CAR, e.g., an inhibitory CAR or a CAR that specifically binds to an antigen other than CD19. In such embodiments, the two or more nucleic acid sequences encoding the CAR are encoded by a single nucleic molecule in the same frame and as a single polypeptide chain. In this aspect, the two or more CARs, can, e.g., be separated by one or more peptide cleavage sites. (e.g., an auto-cleavage site or a substrate for an intracellular protease). Examples of peptide cleavage sites include T2A, P2A, E2A, or F2A sites.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of targeted delivery of nucleic acids are available, such as delivery of polynucleotides with targeted nanoparticles or other suitable sub-micron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Chol") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform can be used as the solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 GLYCOBIOLOGY 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Therapeutic Methods

In one aspect, the disclosure provides methods for treating a disease associated with expression of a tumor antigen described herein.

In one aspect, the present disclosure provides methods of treating cancer (e.g., a hematological cancer such as ALL and CLL) by providing to the subject in need thereof immune effector cells (e.g., T cells, NK cells) that are engineered to express a CAR (e.g., a CD19 CAR, wherein the cancer cells express CD19). In one embodiment, the cancer to be treated is a B cell malignancy. In one embodiment, the cancer to be treated is ALL (acute lymphoblastic leukemia), CLL (chronic lymphocytic leukemia), DLBCL (diffuse large B-cell lymphoma), MCL (Mantle cell lymphoma, or MM (multiple myeloma). In one embodiment, the cancer to be treated is ALL, e.g., refractory or relapsed ALL.

In embodiments, the methods of treating cancer described herein comprise steps of evaluating the subject, as described herein (e.g., evaluating, e.g., predicting the subject's risk for developing severe CRS).

The disclosure includes a type of cellular therapy where immune effector cells (e.g., T cells, NK cells) are genetically modified (e.g., via transduction of a lentiviral vector) to express a CAR and the CAR-expressing cell is infused to a recipient in need thereof. The infused cell is able to kill tumor cells in the recipient. Unlike antibody therapies, CAR-modified immune effector cells (e.g., T cells, NK cells) are able to replicate in vivo resulting in long-term persistence that can lead to sustained tumor control. CAR-expressing cells (e.g., T cells or NK cells) generated using lentiviral vectors will have stable CAR expression. In various aspects, the immune effector cells (e.g., T cells, NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell or NK cell to the patient.

The invention also includes a type of cellular therapy where immune effector cells (e.g., T cells, NK cells) are modified, e.g., by in vitro transcribed RNA, to transiently express a CAR and the CAR-expressing cell is infused to a recipient in need thereof. CAR-expressing cells (e.g., T cells, NK cells) generated through transduction of CAR RNA (e.g., by transfection or electroporation) transiently express RNA CARs for 4, 5, 6, 7, 8, 9, 10, 11, 12, 13, 14, 15 days after transduction. The infused cell is able to kill tumor cells in the recipient. Thus, in various aspects, the immune effector cells (e.g., T cells, NK cells) administered to the patient, is present for less than one month, e.g., three weeks, two weeks, one week, after administration of the T cell to the patient.

In one embodiment, the immune effector cells (e.g., T cells, NK cells) are engineered to express CD19 CAR, for treating a subject having cancer (e.g., a hematological cancer such as ALL and CLL), wherein the cancer cells express CD19. In one embodiment, the cancer to be treated is ALL or CLL. The CD19 CAR molecules to be expressed in an immune effector cell can comprise any anti-CD19 antigen binding domain in the art (e.g., those provided in Table 2) in combination with any of the CAR domains described herein to generate a full CAR construct.

CD19 Associated Diseases and/or Disorders

In one aspect, the disclosure provides methods for treating cancer, e.g., a cancer associated with CD19 expression, with a CAR-expressing cell (e.g., T cell, NK cell) therapy. Exemplary cancers include, but are not limited to e.g., one or more acute leukemias including but not limited to, e.g., B-cell acute lymphocytic leukemia ("B-ALL"), T-cell acute lymphocytic leukemia ("T-ALL"), acute lymphocytic leukemia (ALL); one or more chronic leukemias including but not limited to, e.g., chronic myelogenous leukemia (CML), chronic lymphocytic leukemia (CLL). Additional cancers or hematologic conditions associated with expression of CD19 include, but are not limited to, e.g., B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further, a disease associated with CD19 expression include, but not limited to, e.g., atypical and/or non-classical cancers, malignancies, precancerous conditions or proliferative diseases associated with expression of CD19.

In one embodiment, the disclosure provides methods for treating CLL.

In another embodiment, the disclosure provides methods for treating ALL.

In another embodiment, the disclosure provides methods for treating B-cell ALL.

In embodiments, the disclosure provides methods for treating refractory or relapsed ALL.

In an embodiment, standard of care for CLL includes, but is not limited to exemplary therapies described herein, e.g., described in Table 11, and combinations thereof.

TABLE 11

Exemplary therapies for CLL

| | w/o del (11q) or del (17p) | del (17p) | del (11q) |
|---|---|---|---|
| First line ≥70 yrs with comorbidities | | | |
| Obinutuzumab + chlorambucil | X | X | X |
| Rituxan + chlorambucil | X | | X |
| Rituxan | X | | |
| Chlorambucil | X | | |
| Fludarabine ± Rituxan | X | X | |
| Cladribine | X | | |
| Bendamustine ± Rituxan | X | | X |
| PCR (pentostatin, cyclophosphamide, Rituxan) | X | | X |
| First Line <70 years without significant comorbidities | | | |
| FCR (Fludarabine, cyclophosphamide, Rituxan) | X | X | X |
| FR (Fludarabine, Rituxan) | X | X | |
| PCR | X | | X |
| Bendamustine ± Rituxan | X | | X |
| Obinutuzumab + chlorambucil | X | X | X |
| Second line-Relapsed/Refractory ≥70 years | | | |
| Imbruvica | X | X | X |
| Reduced-dose FCR | X | | X |
| Reduced-dose PCRR | X | | X |
| Bendamustine ± Rituxan | X | | X |
| Ofatumumab | X | X | X |
| Alemutuzumab + Rituxan | X | X | X |
| High dose methylprednisone (HDMP) + rituximab | X | X | X |
| Lenalidomide + Rituxan | X | X | X |
| Dose dense rituximab | X | | X |
| Second line-Relapsed/Refractory < years without significant comorbidities | | | |
| Imbruvica | X | X | X |
| FCR (Fludarabine, cyclophosphaide, Rituxan) | X | | X |
| PCR | X | | X |
| Bendamustine ± Rituxan | X | | X |
| Fludarabine + alemtuzumab | X | | X |
| R-CHOP (Rituxan, cyclophosphamide, dosorubicin, vincristine, prednisone) | X | X | X |
| Ofatumumab | X | X | X |
| OFAR (oxaliplatin, Fludara, cytarabine, Rituxan) | X | X | X |
| HDMP + rituximab | X | X | X |
| Lenalidomide + Rituxan | X | X | X |

In an embodiment, standard of care for CLL includes (1) radiation therapy, (2) chemotherapy, (3) surgery (e.g., removal of the spleen), (4) targeted therapy, (5) stem cell transplantation, and combinations thereof. In an embodiment, the standard of care comprises external radiation therapy. In an embodiment, the standard of care comprises internal radiation therapy (e.g., a radioactive substance sealed in needles, wires or catheters, for example, that are placed directly into or near the cancer).

In an embodiment, standard of care for ALL includes, but is not limited to exemplary therapies described herein, e.g., described in Table 12, and combinations thereof.

TABLE 12

Exemplary therapies for ALL

First Line

RCHOP (Rituxan, cyclophosphamide, doxorubicin, vincristine, prednisone)
Dose dense RCHOP 14 (category 3)
Dose adjusted EPOCH (etoposide, prednisone, vincristine, cyclophosphamide, doxorubicin) + Rituxan
First Line Therapy for subjects with
Poor left ventricular function or very frail RCEPP (rituximab, cyclophosphamide, etoposide, prednisone, procarbazine)
RCEOP (rituximab, cyclophosphamide, etoposide, vincristine, prednisone)
RCNOP (rituximab, cyclophosphamide, mitoxantrone, vincristine, prednisone)
RCEOP (rituximab, cyclophosphamide, etoposide, vincristine, prednisone)
Dose adjusted EPOCH (etoposide, prednisone, vincristine, cyclophosphamide, doxorubicin) + Rituxan
Second line- proceed to high dose therapy
with autologous stem cell rescue DHAP (dexamethasone, cisplatin, cytarabine) ± Rituxan
ESHAP (etoposide, methylprednisolone, cytarabine, cisplatin) ± Rituxan
GDP (gemcitabine, dexamethasone, cisplatin) ± Rituxan
GemOx (gemcitabine, oxaliplatin) ± Rituxan
ICE (ifosfamide, carboplatin, etoposide) + Rituxan
MINE (mesna, ifosfamide, mitoxantrone, etoposide) ± Rituxan
Second-line therapy (non-candidates for high-dose therapy)

CEPP (cyclophosphamide, etoposide, prednisone, procarbazine) ± Rituxan
CEOP (cyclophosphamide, etoposide, vincristine, prednisone) ± Rituxan
DA-EPOCH ± Rituxan
Revlimid ± Rituxan
Rituxan
GemOx ± Rituxan
GDP ± Rituxan
Bendamustine + Rituxan In an embodiment, standard of care for ALL includes (1) chemotherapy, (2) radiation therapy, (3) stem cell transplantation, (4) biological therapy, (5) targeted therapy, and combinations thereof.

In an embodiment, the standard of care includes, but is not limited to, fludarabine with cyclophosphamide (FC); fludarabine with rituximab (FR); fludarabine, cyclophosphamide, and rituximab (FCR); cyclophosphamide, doxorubicin, vincristine and prednisone (CHOP); and combinations thereof. General chemotherapeutic agents considered for use include, but are not limited to anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), vinorelbine (Navelbine®), and combinations thereof.

In an embodiment, chemotherapy comprises an antimetabolite, including, but not limited to, folic acid antagonists (also referred to herein as antifolates), pyrimidine analogs, purine analogs and adenosine deaminase inhibitors): methotrexate (Rheumatrex®, Trexall®), 5-fluorouracil (Adrucil®, Efudex®, Fluoroplex®), floxuridine (FUDF®), cytarabine (Cytosar-U®, Tarabine PFS), 6-mercaptopurine (Puri-Nethol®)), 6-thioguanine (Thioguanine Tabloid®), fludarabine phosphate (Fludara®), pentostatin (Nipent®), pemetrexed (Alimta®), raltitrexed (Tomudex®), cladribine (Leustatin®), clofarabine (Clofarex®, Clolar®), cytarabine liposomal (also known as Liposomal Ara-C, DepoCyt™); decitabine (Dacogen®); hydroxyurea (Hydrea®, Droxia™ and Mylocel™); mercaptopurine (Puri-Nethol®), pralatrexate (Folotyn™) capecitabine (Xeloda®), nelarabine (Arranon®), azacitidine (Vidaza®) and gemcitabine (Gemzar®). Suitable antimetabolites include, e.g., 5-fluorouracil (Adrucil®, Efudex®, Fluoroplex®), floxuridine (FUDF®), capecitabine (Xeloda®), pemetrexed (Alimta®), raltitrexed (Tomudex®) and gemcitabine (Gemzar®), and combinations thereof. In an embodiment, the purine analogue is fludarabine.

In an embodiment, chemotherapy comprises an alkylating agent including, but not limited to nitrogen mustards, ethylenimine derivatives, alkyl sulfonates, nitrosoureas and triazenes, uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®) and combinations thereof. Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); Bendamustine HCl (Treanda®) and combinations thereof. In an embodiment, the alkylating agent is bendamustine. In an embodiment, the alkylating agent is cyclophosphamide.

In an embodiment, the chemotherapeutic agent is a kinase inhibitor, e.g., a tyrosine kinase inhibitor including, but not limited to, erlotinib hydrochloride (Tarceva®); linifanib (N-[4-(3-amino-1H-indazol-4-yl)phenyl]-N'-(2-fluoro-5-methylphenyl)urea, also known as ABT 869, available from Genentech); sunitinib malate (Sutent®); bosutinib (4-[(2,4-dichloro-5-methoxyphenyl)amino]-6-methoxy-7-[3-(4-methylpiperazin-1-yl)propoxy]quinoline-3-carbonitrile, also known as SKI-606, and described in U.S. Pat. No. 6,780,996); dasatinib (Sprycel®); pazopanib (Votrient®); sorafenib (Nexavar®); zactima (ZD6474); and imatinib or imatinib mesylate (Gilvec® and Gleevec®). In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662). In one embodiment, the kinase inhibitor is an MNK inhibitor selected from CGP052088; 4-amino-3-(p-fluorophenylamino)-pyrazolo [3,4-d] pyrimidine (CGP57380); cercosporamide; ETC-1780445-2; and 4-amino-5-(4-fluoroanilino)-pyrazolo [3,4-d] pyrimidine.

In an embodiment, targeted therapy includes, but is not limited to an anti-CD20 antibody or functional fragment thereof, such as, e.g., rituximab (Riuxan® and MabThera®); tositumomab (Bexxar®); and ofatumumab (Arzerra®), and combinations thereof. In one embodiment, the targeted therapy includes, but is not limited to, an anti-CD52 antibody or functional fragment thereof such as, e.g., alemtuzumab (Campath®).

In an embodiment, biologic therapy comprises immunotherapy. Exemplary anthracyclines include, without limitation, doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; desacetylravidomycin and combinations thereof.

In an embodiment, stem cell transplantation comprises an autogeneic stem cell transplant. In an embodiment, stem cell transplantation comprises an allogenic stem cell transplant. In an embodiment, stem cell transplantation comprises allogeneic bone marrow transplantation. In an embodiment, stem cell transplantation comprises a hematopoietic stem cell transplantation (HSCT). In an embodiment, hematopoietic stem cells are derived from various tissues including, but not limited to bone marrow, peripheral blood, umbilical cord blood, and combinations thereof.

In one aspect, the disclosure provides methods for treating a disease associated with CD19 expression. In one aspect, the invention provides methods for treating a disease wherein part of the tumor is negative for CD19 and part of the tumor is positive for CD19. For example, provided methods are useful for treating subjects that have undergone treatment for a disease associated with elevated expression of CD19, wherein the subject that has undergone treatment for elevated levels of CD19 exhibits a disease associated with elevated levels of CD19.

In one aspect, provided methods comprise a vector comprising CD19 CAR operably linked to promoter for expression in mammalian cells (e.g., T cells or NK cells). In one aspect, provided methods comprise a recombinant cell (e.g., T cell or NK cell) expressing a CD19 CAR for use in treating CD19-expressing tumors, wherein the recombinant T cell expressing the CD19 CAR is termed a CD19 CAR-expressing cell. In one aspect, a CD19 CAR-expressing cell (e.g., T cell, NK cell) administered according to provided methods is capable of contacting a tumor cell with at least one CD19 CAR expressed on its surface such that the CAR-expressing cell targets the tumor cell and growth of the tumor is inhibited.

In one aspect, the disclosure features to a method of inhibiting growth of a CD19-expressing tumor cell, comprising contacting the tumor cell with a CD19 CAR-expressing cell (e.g., T cell, NK cell) described herein such that the CAR-expressing cell is activated in response to the antigen and targets the cancer cell, wherein the growth of the tumor is inhibited.

In one aspect, the disclosure includes a type of cellular therapy where T cells are genetically modified to express a CAR and the CAR-expressing cell (e.g., T cell, NK cell) is infused to a recipient in need thereof. The infused cell is able to kill tumor cells in the recipient. Unlike antibody therapies, CAR-modified cells (e.g., T cells or NK cells) are able to replicate in vivo resulting in long-term persistence that can lead to sustained tumor control. In various aspects, the cells administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the cell to the patient.

The disclosure also includes a type of cellular therapy where cells (e.g., T cells, NK cells) are modified, e.g., by in vitro transcribed RNA, to transiently express a chimeric antigen receptor (CAR) and the CAR-expressing cell (e.g., T cell, NK cell) is infused to a recipient in need thereof. The infused cell is able to kill tumor cells in the recipient. Thus, in various aspects, the cells administered to the patient, are present for less than one month, e.g., three weeks, two weeks, one week, after administration of the cell (e.g., T cell, NK cell) to the patient.

Without wishing to be bound by any particular theory, the anti-tumor immunity response elicited by the CAR-modified cells (e.g, T cells, NK cells) may be an active or a passive immune response, or alternatively may be due to a direct vs indirect immune response. In one aspect, the CAR transduced T cells exhibit specific proinflammatory cytokine secretion and potent cytolytic activity in response to human cancer cells expressing the CD19, resist soluble CD19 inhibition, mediate bystander killing and mediate regression of an established human tumor. For example, antigen-less tumor cells within a heterogeneous field of CD19-expressing tumor may be susceptible to indirect destruction by CD19-redirected T cells that has previously reacted against adjacent antigen-positive cancer cells.

In one aspect, the fully-human CAR-modified cells (e.g., T cells, NK cells) described herein may be a type of vaccine for ex vivo immunization and/or in vivo therapy in a mammal. In one aspect, the mammal is a human.

With respect to ex vivo immunization, at least one of the following occurs in vitro prior to administering the cell into a subject: i) expansion of the cells, ii) introducing a nucleic acid encoding a CAR to the cells or iii) cryopreservation of the cells.

Ex vivo procedures are well known in the art and are discussed more fully below. Briefly, cells are isolated from a subject (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

Hematologic Cancer

Hematological cancer conditions are types of cancer such as leukemia and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

The present disclosure provides for compositions and methods for treating cancer. In one aspect, the cancer is a hematologic cancer including but is not limited to a leukemia or a lymphoma. In one aspect, the CAR-expressing cells (e.g., T cells, NK cells) of the invention may be used to treat cancers and malignancies such as, but not limited to, e.g., acute leukemias including but not limited to, e.g., acute myeloid leukemia (AML), B-cell acute lymphoid leukemia ("B-ALL"), T-cell acute lymphoid leukemia ("T-ALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, myeloproliferative neoplasm; a histiocytic disorder (e.g., a mast cell disorder or a blastic plasmacytoid dendritic cell neoplasm); a mast cell disorder, e.g., systemic mastocytosis or mast cell leukemia; B-cell prolymphocytic leukemia, plasma cell myeloma, and "preleukemia" which are a diverse collection of hematological conditions united by ineffective production (or dysplasia) of myeloid blood cells, and the like. Further a disease associated with CD19 expression includes, but not limited to, e.g., atypical and/or non-classical cancers, malignancies, precancerous conditions or proliferative diseases expressing CD19.

The present disclosure also provides methods for inhibiting the proliferation or reducing a CD19-expressing cell population, the methods comprising contacting a population of cells comprising a CD19-expressing cell with a CD19 CAR-expressing cell (e.g., T cell, NK cell) described herein that binds to the CD19-expressing cell. In a specific aspect, the disclosure provides methods for inhibiting the proliferation or reducing the population of cancer cells expressing CD19, the methods comprising contacting the CD19-expressing cancer cell population with a CD19 CAR-expressing cell (e.g., T cell, NK cell) described herein that binds to the CD19-expressing cell. In one aspect, the present disclosure provides methods for inhibiting the proliferation or reducing the population of cancer cells expressing CD19, the methods comprising contacting the CD19-expressing cancer cell population with a CD19 CAR-expressing cell (e.g., T cell, NK cell) described herein that binds to the CD19-expressing cell. In certain aspects, the anti-CD19 CAR-expressing cell (e.g., T cell, NK cell) reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with CD19-expressing cells relative to a negative control. In one aspect, the subject is a human.

The present disclosure also provides methods for preventing, treating and/or managing a disease associated with CD19-expressing cells (e.g., a hematologic cancer or atypical cancer expressing CD19), the methods comprising administering to a subject in need a CAR-expressing cell (e.g., T cell, NK cell) described herein that binds to the CD19-expressing cell. In one aspect, the subject is a human. Non-limiting examples of disorders associated with CD19-expressing cells include autoimmune disorders (such as lupus), inflammatory disorders (such as allergies and asthma) and cancers (such as hematological cancers or atypical cancers expressing CD19).

The present disclosure also provides methods for preventing, treating and/or managing a disease associated with CD19-expressing cells, the methods comprising administering to a subject in need a CD19 CAR-expressing cell (e.g., T cell, NK cell) described herein that binds to the CD19-expressing cell. In one embodiment, the subject is a human.

The present disclosure provides methods for preventing relapse of cancer associated with CD19-expressing cells (e.g., a hematological cancer such as ALL and CLL), the methods comprising administering to a subject in need thereof a CD19 CAR-expressing cell (e.g., T cell, NK cell) described herein that binds to the CD19-expressing cell. In one aspect, the methods comprise administering to the subject in need thereof an effective amount of a CD19 CAR-expressing cell (e.g., T cell, NK cell) described herein that binds to the CD19-expressing cell in combination with an effective amount of another therapy.

In some embodiments, a CAR-expressing cell (e.g., CD19 CAR-expressing cell) described herein is used to deplete a B cell (e.g., a population of B cells, e.g., regulatory B cells). Without wishing to be bound by theory, it is believed that depletion of B cells, e.g., regulatory B cells, can improve the tumor microenvironment such that anti-cancer therapies (e.g., therapies described herein) can be more effective (e.g., than without depletion of the B cells). Thus, provided herein is a method for reducing, e.g., depleting, regulatory cells (e.g., regulatory B cells). The method includes administering a CAR-expressing cell (e.g., CD19 CAR-expressing cell) described herein in an amount sufficient to reduce the regulatory cells. In some embodiments, the methods can be used to modulate a tumor microenvironment, e.g., to enhance the effectiveness of a therapy described herein.

In some embodiments, a dose of CAR-expressing cells (e.g., CAR-expressing cells described herein, e.g., CD19 CAR-expressing cells described herein) comprises about $10^4$ to about $10^9$ cells/kg, e.g., about $10^4$ to about $10^5$ cells/kg, about $10^5$ to about $10^6$ cells/kg, about $10^6$ to about $10^7$ cells/kg, about $10^7$ to about $10^8$ cells/kg, or about $10^8$ to about $10^9$ cells/kg. In embodiments, the dose of CAR-expressing cells comprises about $0.6 \times 10^6$ cells/kg to about $2 \times 10^7$ cells/kg. In some embodiments, a dose of CAR-expressing cells described herein (e.g., CD19 CAR-expressing cells) comprises about $2 \times 10^5$, $1 \times 10^6$, $1.1 \times 10^6$, $2 \times 10^6$, $3 \times 10^6$, $3.6 \times 10^6$, $5 \times 10^6$, $1 \times 10^7$, $1.8 \times 10^7$, $2 \times 10^7$, $5 \times 10^7$, $1 \times 10^8$, $2 \times 10^8$, $3 \times 10^8$, or $5 \times 10^8$ cells/kg. In some embodiments, a dose of CAR cells (e.g., CD19 CAR-expressing cells) comprises at least about $1 \times 10^6$, $1.1 \times 10^6$, $2 \times 10^6$, $3.6 \times 10^6$, $5 \times 10^6$, $1 \times 10^7$, $1.8 \times 10^7$, $2 \times 10^7$, $5 \times 10^7$, $1 \times 10^8$, $2 \times 10^8$, $3 \times 10^8$, or $5 \times 10^8$ cells/kg. In some embodiments, a dose of CAR cells (e.g., CD19 CAR-expressing cells) comprises up to about $1 \times 10^6$, $1.1 \times 10^6$, $2 \times 10^6$, $3.6 \times 10^6$, $5 \times 10^6$, $1 \times 10^7$, $1.8 \times 10^7$, $2 \times 10^7$, $5 \times 10^7$, $1 \times 10^8$, $2 \times 10^8$, $3 \times 10^8$, or $5 \times 10^8$ cells/kg. In some embodiments, a dose of CAR cells (e.g., CD19 CAR-expressing cells) comprises about $1.1 \times 10^6$-$1.8 \times 10^7$ cells/kg. In some embodiments, a dose of CAR cells (e.g., CD19 CAR-expressing cell) comprises about $1 \times 10^7$, $2 \times 10^7$, $5 \times 10^7$, $1 \times 10^8$, $2 \times 10^8$, $3 \times 10^8$, $5 \times 10^8$, $1 \times 10^9$, $2 \times 10^9$, or $5 \times 10^9$ cells. In some embodiments, a dose of CAR cells (e.g., e.g., CD19 CAR-expressing cells) comprises at least about $1 \times 10^7$, $2 \times 10^7$, $5 \times 10^7$, $1 \times 10^8$, $2 \times 10^8$, $3 \times 10^8$, $5 \times 10^8$, $1 \times 10^9$, $2 \times 10^9$, or $5 \times 10^9$ cells. In some embodiments, a dose of CAR cells (e.g., e.g., CD19 CAR-expressing cells) comprises up to about $1 \times 10^7$, $2 \times 10^7$, $5 \times 10^7$, $1 \times 10^8$, $2 \times 10^8$, $3 \times 10^8$, $5 \times 10^8$, $1 \times 10^9$, $2 \times 10^9$, or $5 \times 10^9$ cells.

In some embodiments, a dose of CAR cells (e.g., CD19 CAR-expressing cells) comprises up to about $1 \times 10^7$, $1.5 \times 10^7$, $2 \times 10^7$, $2.5 \times 10^7$, $3 \times 10^7$, $3.5 \times 10^7$, $4 \times 10^7$, $5 \times 10^7$, $1 \times 10^8$, $1.5 \times 10^8$, $2 \times 10^8$, $2.5 \times 10^8$, $3 \times 10^8$, $3.5 \times 10^8$, $4 \times 10^8$, $5 \times 10^8$, $1 \times 10^9$, $2 \times 10^9$, or $5 \times 10^9$ cells. In some embodiments, a dose of CAR cells (e.g., CD19 CAR-expressing cell) comprises up to about $1-3 \times 10^7$ to $1-3 \times 10^8$ cells. In some embodiments, the subject is administered about $1-3 \times 10^7$ of CD19 CAR-expressing cells. In other embodiments, the subject is administered about $1-3 \times 10^8$ of CD19 CAR-expressing cells.

In some embodiments, a dose of CAR-expressing cells (e.g., CAR-expressing cells described herein, e.g., CD19 CAR-expressing cells described herein) comprises about $1 \times 10^6$ cells/m$^2$ to about $1 \times 10^9$ cells/m$^2$, e.g., about $1 \times 10^7$ cells/m$^2$ to about $5 \times 10^8$ cells/m$^2$, e.g., about $1.5 \times 10^7$ cells/m$^2$, about $2 \times 10^7$ cells/m$^2$, about $4.5 \times 10^7$ cells/m$^2$, about $10^8$ cells/m$^2$, about $1.2 \times 10^8$ cells/m$^2$, or about $2 \times 10^8$ cells/m$^2$.

In embodiments, the CD19 CAR-expressing cells are administered in a plurality of doses, e.g., a first dose, a second dose, and optionally a third dose. In embodiments, the method comprises treating a subject (e.g., an adult subject) having a cancer (e.g., acute lymphoid leukemia (ALL)), comprising administering to the subject a first dose, a second dose, and optionally one or more additional doses, each dose comprising immune effector cells expressing a CAR molecule, e.g., a CD19 CAR molecule, e.g., the CTL019 full amino acid sequence as set out in Table 1 herein.

In embodiments, the method comprises administering a dose of $2-5 \times 10^6$ viable CAR-expressing cells/kg, wherein the subject has a body mass of less than 50 kg; or administering a dose of $1.0-2.5 \times 10^8$ viable CAR-expressing cells, wherein the subject has a body mass of at least 50 kg.

In embodiments, a single dose is administered to the subject, e.g., pediatric subject.

In embodiments, the doses are administered on sequential days, e.g., the first dose is administered on day 1, the second dose is administered on day 2, and the optional third dose (if administered) is administered on day 3.

In embodiments, a fourth, fifth, or sixth dose, or more doses, are administered.

In embodiments, the first dose comprises about 10% of the total dose, the second dose comprises about 30% of the total dose, and the third dose comprises about 60% of the total dose, wherein the aforementioned percentages have a sum of 100%. In embodiments, the first dose comprises about 9-11%, 8-12%, 7-13%, or 5-15% of the total dose. In embodiments, the second dose comprises about 29-31%, 28-32%, 27-33%, 26-34%, 25-35%, 24-36%, 23-37%, 22-38%, 21-39%, or 20-40% of the total dose. In embodiments, the third dose comprises about 55-65%, 50-70%, 45-75%, or 40-80% of the total dose. In embodiments, the total dose refers to the total number of viable CAR-expressing cells administered over the course of 1 week, 2 weeks, 3 weeks, or 4 weeks. In some embodiments wherein two doses are administered, the total dose refers to the sum of the number of viable CAR-expressing cells administered to the subject in the first and second doses. In some embodiments wherein three doses are administered, the total dose refers to the sum of the number of viable CAR-expressing cells administered to the subject in the first, second, and third doses.

In embodiments, the dose is measured according to the number of viable CAR-expressing cells therein. CAR expression can be measured, e.g., by flow cytometry using an antibody molecule that binds the CAR molecule and a detectable label. Viability can be measured, e.g., by Cellometer.

In embodiments, the viable CAR-expressing cells are administered in ascending doses. In embodiments, the second dose is larger than the first dose, e.g., larger by 10%, 20%, 30%, or 50%. In embodiments, the second dose is twice, three times, four times, or five times the size of the first dose. In embodiments, the third dose is larger than the second dose, e.g., larger by 10%, 20%, 30%, or 50%. In embodiments, the third dose is twice, three times, four times, or five times the size of the second dose.

In certain embodiments, the method includes one, two, three, four, five, six, seven or all of a)-h) of the following:

a) the number of CAR-expressing, viable cells administered in the first dose is no more than ⅓, of the number of CAR-expressing, viable cells administered in the second dose;

b) the number of CAR-expressing, viable cells administered in the first dose is no more than 1/X, wherein X is 2, 3, 4, 5, 6, 7, 8, 9, 10, 15, 20, 30, 40 or 50, of the total number of CAR-expressing, viable cells administered;

c) the number of CAR-expressing, viable cells administered in the first dose is no more than $1\times10^7$, $2\times10^7$, $3\times10^7$, $4\times10^7$, $5\times10^7$, $6\times10^7$, $7\times10^7$, $8\times10^7$, $9\times10^7$, $1\times10^8$, $2\times10^8$, $3\times10^8$, $4\times10^8$, or $5\times10^8$ CAR-expressing, viable cells, and the second dose is greater than the first dose;

d) the number of CAR-expressing, viable cells administered in the second dose is no more than ½ of the number of CAR-expressing, viable cells administered in the third dose;

e) the number of CAR-expressing, viable cells administered in the second dose is no more than 1/Y, wherein Y is 2, 3, 4, 5, 6, 7, 8, 9, 10, 15, 20, 30, 40 or 50, of the total number of CAR-expressing, viable cells administered;

f) the number of CAR-expressing, viable cells administered in the second dose is no more than $1\times10^7$, $2\times10^7$, $3\times10^7$, $4\times10^7$, $5\times10^7$, $6\times10^7$, $7\times10^7$, $8\times10^7$, $9\times10^7$, $1\times10^8$, $2\times10^8$, $3\times10^8$, $4\times10^8$, or $5\times10^8$ CAR-expressing, viable cells, and the third dose is greater than the second dose;

h) the dosages and time periods of administration of the first, second, and optionally third doses are selected such that the subject experiences CRS at a level no greater than 4, 3, 2, or 1.

In embodiments, the total dose is about $5\times10^8$ CAR-expressing, viable cells. In embodiments, the total dose is about $5\times10^7$-$5\times10^8$ CAR-expressing, viable cells. In embodiments, the first dose is about $5\times10^7$ (e.g., ±10%, 20%, or 30%) CAR-expressing, viable cells, the second dose is about $1.5\times10^8$ (e.g., ±10%, 20%, or 30%) CAR-expressing, viable cells, and the third dose is about $3\times10^8$ (e.g., ±10%, 20%, or 30%) CAR-expressing, viable cells.

In embodiments, the subject is evaluated for CRS after receiving a dose, e.g., after receiving the first dose, the second dose, and/or the third dose.

In embodiments, the subject receives a CRS treatment, e.g., tocilizumab, a corticosteroid, etanercept, or siltuximab. In embodiments, the CRS treatment is administered before or after the first dose of cells comprising the CAR molecule. In embodiments, the CRS treatment is administered before or after the second dose of cells comprising the CAR molecule. In embodiments, the CRS treatment is administered before or after the third dose of cells comprising the CAR molecule. In embodiments, the CRS treatment is administered between the first and second doses of cells comprising the CAR molecule, and/or between the second and third doses of cells comprising the CAR molecule.

In embodiments, in a subject having CRS after the first dose, e.g., CRS grade 1, 2, 3, or 4, the second dose is administered at least 2, 3, 4, or 5 days after the first dose. In embodiments, in a subject having CRS after the second dose, e.g., CRS grade 1, 2, 3, or 4, the third dose is administered at least 2, 3, 4, or 5 days after the second dose. In embodiments, in a subject having CRS after the first dose, the second dose of CAR-expressing cells is delayed relative to when the second dose would have been administered had the subject not had CRS. In embodiments, in a subject having CRS after the second dose, the third dose of CAR-expressing cells is delayed relative to when the third dose would have been administered had the subject not had CRS.

In embodiments, the subject has a cancer with a high disease burden before the first dose is administered. In embodiments, the subject has bone marrow blast levels of at least 1%, 2%, 3%, 4%, 5%, 6%, 7%, 8%, 9%, 10%, 15%, 20%, 25%, 30%, 35%, 40%, 45%, or 50%, e.g., at least 5%. In embodiments, the subject has a cancer in stage I, II, III, or IV. In embodiments, the subject has a tumor mass of at least 1, 2, 5, 10, 20, 50, 100, 200, 500, or 1000 g, e.g., in a single tumor or a plurality of tumors.

In some embodiments, the subject has cancer (e.g., a solid cancer or a hematological cancer as described herein). In an embodiment, the subject has CLL. In embodiments, the subject has ALL. In other embodiments, the subject has multiple myeloma.

In one embodiment, the cancer is a disease associated with CD19 expression, e.g., as described herein. In other embodiments, the cancer is a disease associated with a tumor antigen, e.g., as described herein. In embodiments, the CAR molecule is a CAR molecule as described herein.

In some embodiments, a subject treated with a CAR-expressing cell described herein is evaluated after treatment by a molecular imaging method, e.g., FDG-PET/CT. In embodiments, the subject undergoes molecular imaging 1, 2, or 3 months after treatment. In embodiments, the subject undergoes the molecular imaging when the subject has no symptoms of CRS. In embodiments, the subject has DLBCL or FL.

Combination Therapy

It will be appreciated that any cancer therapy as described herein can be administered in combination with one or more additional therapies to treat and/or reduce the symptoms of cancer described herein. The pharmaceutical compositions can be administered concurrently with, prior to, or subsequent to, one or more other additional therapies or therapeutic agents. In an embodiment, a CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

In further aspects, a CAR-expressing cell described herein may be used in a treatment regimen in combination with surgery, chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation peptide vaccine, such as that described in Izumoto et al. 2008 J NEUROSURG 108:963-971.

In one embodiment, a CAR-expressing cell described herein can be used in combination with a chemotherapeutic agent. Exemplary chemotherapeutic agents include an anthracycline (e.g., doxorubicin (e.g., liposomal doxorubicin)), a vinca alkaloid (e.g., vinblastine, vincristine, vindesine, vinorelbine), an alkylating agent (e.g., bendamustine, cyclophosphamide, decarbazine, melphalan, ifosfamide, temozolomide), an immune cell antibody (e.g., alemtuzamab, gemtuzumab, rituximab, tositumomab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide), and combinations thereof.

General Chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Exemplary alkylating agents include, without limitation, nitrogen mustards, ethylenimine derivatives, alkyl sulfonates, nitrosoureas and triazenes, uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®) and combinations thereof. Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); Bendamustine HCl (Treanda®) and combinations thereof.

Exemplary mTOR inhibitors include, without limitation, RAD001, temsirolimus; ridaforolimus (formally known as deferolimus, (1R,2R,4S)-4-[(2R)-2 [(1R,9S,12S,15R,16E, 18R,19R,21R, 23S,24E,26E,28Z,30S,32S,35R)-1,18-dihydroxy-19,30-dimethoxy-15,17,21,23, 29,35-hexamethyl-2, 3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502, CAS 1013101-36-4); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-, inner salt (SF1126, CAS 936487-67-1) (SEQ ID NO: 337), XL765 and combinations thereof.

Exemplary immunomodulators include, without limitation, afutuzumab (available from Roche®); pegfilgrastim (Neulasta®); lenalidomide (CC-5013, Revlimid®); thalidomide (Thalomid®), actimid (CC4047); IRX-2 (mixture of human cytokines including interleukin 1, interleukin 2, and interferon γ, CAS 951209-71-5, available from IRX Therapeutics) and combinations thereof.

Exemplary anthracyclines include, without limitation, doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; desacetylravidomycin and combinations thereof.

Exemplary vinca alkaloids include, without limitation, vinorelbine tartrate (Navelbine®), Vincristine (Oncovin®), Vindesine (Eldisine®)); vinblastine (also known as vinblastine sulfate, vincaleukoblastine and VLB, Alkaban-AQ® and Velban®); vinorelbine (Navelbine®) and combinations thereof.

Exemplary proteosome inhibitors include, without limitation, bortezomib (Velcade®); carfilzomib (PX-171-007, (S)-4-Methyl-N—((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); 0-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912) and combinations thereof.

Exemplary GITR agonists include, without limitation, GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025, 962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In an embodiment, a CAR expressing cell described herein, such as, e.g., a CD19 CAR-expressing cell (e.g., T cell, NK cell), e.g., CTL019 is administered to a subject, e.g., a subject identified using the methods disclosed herein, in combination with an mTOR inhibitor, e.g., an mTOR inhibitor described herein, e.g., a target of the rapamycin signaling pathway such as RAD001. In an embodiment, the mTOR inhibitor is administered prior to the CAR-expressing cell. For example, in an embodiment, the mTOR inhibitor can be administered prior to apheresis of the cells. In an embodiment, the subject has cancer (e.g., a hematological cancer such as ALL and CLL). In an embodiment, the subject has ALL. In an embodiment, the subject has CLL.

In an embodiment, a CAR expressing cell described herein, such as, e.g., a CD19 CAR-expressing cell (e.g., T cell, NK cell), e.g., CTL019, is administered to a subject, e.g., a subject identified using the methods disclosed herein, in combination with a GITR agonist, e.g., a GITR agonist described herein. In an embodiment, the GITR agonist is administered prior to the CAR-expressing cell. For example, in an embodiment, the GITR agonist can be administered prior to apheresis of the cells. In an embodiment, the subject has cancer (e.g., a hematological cancer such as ALL and CLL). In an embodiment, the subject has ALL. In an embodiment, the subject has CLL.

In embodiments, the subject is administered an additional agent (in further combination with a CAR-expressing cell and optionally a therapy to treat CRS), where the additional agent is an inhibitor of an inhibitory molecule, e.g., checkpoint molecule, e.g., PD-1, PD-L1, PD-L2, CTLA4, TIM3, CEACAM (e.g., CEACAM-1, CEACAM-3 and/or CEACAM-5), LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, or TGF (e.g., TGF beta). In embodiments, the additional agent is an inhibitor of PD-L1, e.g., FAZ053 (a hIgG4 humanized anti-PD-L1 monoclonal antibody), MPDL3280A, durvalumab (DEMI-4736), avelumab (MSB-0010718C), or BMS-936559. In embodiments, the additional agent is an additional inhibitor of PD-1, e.g., pembrolizumab, nivolumab, PDR001, MEDI-0680 (AMP-514), AMP-224, REGN-2810, or BGB-A317. In embodiments, the additional agent is an inhibitor of CTLA-4, e.g., ipilimumab. In embodiments, the additional agent is an inhibitor of LAG-3, e.g., LAG525 (a hIgG4 humanized anti-LAG-3 monoclonal antibody). In embodiments, the additional agent is an inhibitor of TIM-3, e.g., MBG453 (a hIgG4 humanized anti-TIM-3 monoclonal antibody). In embodiments, the additional agent is an inhibitor of the enzyme, B-Raf, e.g., dabrafenib (GSK2118436; N-{3-[5-(2-aminopyrimidin-4-yl)-2-tert-butyl-1,3-thiazol-4-yl]-2-fluorophenyl}-2,6-difluorobenzenesulfonamide). In embodiments, the additional agent is an inhibitor of MEK1 and/or MEK2, e.g., trametinib (N-(3-{3-Cyclopropyl-5-[(2-fluoro-4-iodophenyl)amino]-6, 8-dimethyl-2,4,7-trioxo-3,4,6,7-tetrahydropyrido[4,3-d]pyrimidin-1(2H)-yl}phenyl)acetamide). In embodiments, the additional agent comprises dabrafenib and trametinib. In embodiments, the additional agent is an inhibitor of GITR, e.g., GWN323. In embodiments, the additional agent is an agonist of STING (Stimulator of Interferon Genes), e.g., MIW815. In embodiments, the additional agent is an IL-15 agonist, e.g., NIZ985. In embodiments, the additional agent an inhibitor of adenosine receptor, e.g., NIR178. In embodiments, the additional agent is an inhibitor of macrophage colony stimulating factor (CSF-1), e.g., MCS110. In embodiments, the additional agent is an inhibitor of cMet, e.g., INC280. In embodiments, the additional agent is an inhibitor of porcupine (PORCN), e.g., WNT974. In embodiments, the additional agent is a histone deacetylase inhibitor, e.g., panobinost. In embodiments, the additional agent is an mTOR inhibitor, e.g., everolimus. In embodiments, the additional agent is a second mitochondrial-derived activator of caspases (SMAC) mimetic and/or an inhibitor of IAP (inhibiotor of apoptosis protein) family of proteins, e.g., LCL161. In embodiments, the additional agent is an inhibitor epidermal growth factor receptor (EGFR), e.g., EGF816. In embodiments, the additional agent is an inhibitor of IL-17, e.g., CJM112. In embodiments, the additional agent is an inhibitor of IL-1beta, e.g., ILARIS.

Kinase Inhibitor

In one embodiment, a CAR-expressing cell described herein may be used in a treatment regimen in combination with a kinase inhibitor, e.g., a CDK4 inhibitor, a BTK inhibitor, an MNK inhibitor, an mTOR inhibitor, an ITK inhibitor, etc.

In an embodiment, the kinase inhibitor is a CDK4 inhibitor, e.g., a CDK4 inhibitor described herein, e.g., a CDK4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo [3,4-d] pyrimidine. The MNK inhibitor can be, e.g., a MNK1a, MNK1b, MNK2a and/or MNK2b inhibitor.

In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment, the kinase inhibitor is an mTOR inhibitor selected from temsirolimus; ridaforolimus (1R,2R,4S)-4-[(2R)-2 [(1R,9S,12S,15R,16E,18R,19R,21R, 23S,24E,26E,28Z,30S,32S,35R)-1,18-dihydroxy-19,30-dimethoxy-15,17,21,23, 29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl) methanol (AZD8055); 2-mmino-8-[trans-4-(2-hydroxyethoxy)cyclohexyl]-6-(6-methoxy-3-pyridinyl)-4-methyl-pyrido[2,3-d]pyrimidin-7(8H)-one (PF04691502); and N$^2$-[1,4-dioxo-4-[[4-(4-oxo-8-phenyl-4H-1-benzopyran-2-yl) morpholinium-4-yl]methoxy]butyl]-L-arginylglycyl-L-α-aspartylL-serine-, inner salt (SF1126) (SEQ ID NO: 337); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo [3,4-d] pyrimidine (CGP57380); cercosporamide; ETC-1780445-2; and 4-amino-5-(4-fluoroanilino)-pyrazolo [3,4-d] pyrimidine.

Combination with A Low, Immune Enhancing, Dose of an mTOR Inhibitor

Methods described herein use low, immune enhancing, doses of mTOR inhibitors, e.g., allosteric mTOR inhibitors, including rapalogs such as RAD001. Administration of a low, immune enhancing, dose of an mTOR inhibitor (e.g., a dose that is insufficient to completely suppress the immune system, but sufficient to improve immune function) can optimize the performance of immune effector cells, e.g., T cells or CAR-expressing cells, in the subject. Methods for measuring mTOR inhibition, dosages, treatment regimens, and suitable pharmaceutical compositions are described in U.S. Patent Application No. 2015/0140036, hereby incorporated by reference.

Inhibitory Molecule Inhibitors/Checkpoint Inhibitors

In one embodiment, the subject can be administered an agent which enhances the activity of a CAR-expressing cell. For example, in one embodiment, the agent can be an agent which inhibits a checkpoint molecule. Checkpoint molecules, e.g., Programmed Death 1 (PD1), can, in some embodiments, decrease the ability of a CAR-expressing cell to mount an immune effector response. Examples of checkpoint molecules include PD1, PD-L1, PD-L2, CTLA4, TIM3, CEACAM (e.g., CEACAM-1, CEACAM-3, and/or CEACAM-5), LAGS, VISTA, BTLA, TIGIT, LAIR1, CD160, 2B4 and TGF (e.g., TGF beta).

The methods described herein can include administration of a CAR-expressing cell in combination with a checkpoint inhibitor. In some embodiments, the checkpoint inhibitor is administered prior to the CAR-expressing cell, e.g., two weeks, 12 days, 10 days, 8 days, one week, 6 days, 5 days, 4 days, 3 days, 2 days or 1 day before administration of the CAR-expressing cell. In some embodiments, the checkpoint inhibitor is administered concurrently with the CAR-expressing cell.

Inhibition of a checkpoint molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., a siRNA or shRNA, can be used to inhibit expression of a checkpoint molecule in the CAR-expressing cell. In an embodiment, the inhibitor is a shRNA. In an embodiment, the checkpoint molecule is inhibited within a CAR-expressing cell. In these embodiments, a dsRNA molecule that inhibits expression of the checkpoint molecule is linked to the nucleic acid that encodes a component, e.g., all of the components, of the CAR. In one embodiment, the inhibitor of an inhibitory signal can be, e.g., an antibody or antibody fragment that binds to a checkpoint molecule. For example, the agent can be an antibody or antibody fragment that binds to PD1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206).). In an embodiment, the agent is an antibody or antibody fragment that binds to TIM3. In an embodiment, the agent is an antibody or antibody fragment that binds to LAG3. In an embodiment, the agent is an antibody or antibody fragment that binds to CEACAM.

PD1 is an inhibitory member of the CD28 family of receptors that also includes CD28, CTLA-4, ICOS, and BTLA. PD1 is expressed on activated B cells, T cells and myeloid cells (Agata et al. 1996 INT. IMMUNOL 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 NAT IMMUNOL 2:261-8; Carter et al. 2002 EUR J IMMUNOL 32:634-43). PD-L1 is abundant in human cancers (Dong et al. 2003 J MOL MED 81:281-7; Blank et al. 2005 CANCER IMMUNOL. IMMUNOTHER. 54:307-314; Konishi et al. 2004 CLIN CANCER RES 10:5094). Immune suppression can be reversed by inhibiting the local interaction of PD1 with PD-L1. Antibodies, antibody fragments, and other inhibitors of PD1, PD-L1 and PD-L2 are available in the art and may be used combination with a CAR described herein, e.g., a CD19 CAR described herein. For example, nivolumab (also referred to as BMS-936558 or MDX1106; Bristol-Myers Squibb) is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. Pidilizumab (CT-011; Cure Tech) is a humanized IgG1k monoclonal antibody that binds to PD1Pidilizumab and other humanized anti-PD1 monoclonal antibodies are disclosed in WO2009/101611. Lambrolizumab (also referred to as MK03475; Merck) is a humanized IgG4 monoclonal antibody that binds to PD1. Lambrolizumab and other humanized anti-PD1 antibodies are disclosed in U.S. Pat. No. 8,354,509 and WO2009/114335. MDPL3280A (Genentech/Roche) is a human Fc optimized IgG1 monoclonal antibody that binds to PD-L1. MDPL3280A and other human monoclonal antibodies to PD-L1 are disclosed in U.S. Pat. No. 7,943,743 and U.S Publication No.: 20120039906. Other anti-PD-L1 binding agents include YW243.55.570 (heavy and light chain variable regions are shown in SEQ ID NOs 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD1 and B7-H1. Other anti-PD1 antibodies include AMP 514 (Amplimmune), among others, e.g., anti-PD1 antibodies disclosed in U.S. Pat. No. 8,609,089, US 2010028330, and/or US 20120114649.

In one embodiment, the anti-PD-1 antibody or fragment thereof is an anti-PD-1 antibody molecule as described in US 2015/0210769, entitled "Antibody Molecules to PD-1 and Uses Thereof," incorporated by reference in its entirety. In one embodiment, the anti-PD-1 antibody molecule includes at least one, two, three, four, five or six CDRs (or collectively all of the CDRs) from a heavy and light chain variable region from an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-PD-1 antibody molecule comprises at least one, two, three or four variable regions from an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1, or encoded by the nucleotide sequence in Table 1; or as described in Table 1 of US 2015/0210769; or encoded by the nucleotide sequence in Table 1; or a sequence substantially identical (e.g., at least 80%, 85%, 90%, 92%, 95%, 97%, 98%, 99% or higher identical) to any of the aforesaid sequences.

In one embodiment, the anti-PD-1 antibody molecule includes:

(a) a heavy chain variable region (VH) comprising a VHCDR1 amino acid sequence of SEQ ID NO: 4, a VHCDR2 amino acid sequence of SEQ ID NO: 5, and a VHCDR3 amino acid sequence of SEQ ID NO: 3; and a light chain variable region (VL) comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769;

(b) a VH comprising a VHCDR1 amino acid sequence chosen from SEQ ID NO: 1; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769;

(c) a VH comprising a VHCDR1 amino acid sequence of SEQ ID NO: 224, a VHCDR2 amino acid sequence of SEQ ID NO: 5, and a VHCDR3 amino acid sequence of SEQ ID NO: 3; and a VL comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769; or (d) a VH comprising a VHCDR1 amino acid sequence of SEQ ID NO: 224; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769.

In the combinations herein below, in another embodiment, the anti-PD-1 antibody molecule comprises (i) a heavy chain variable region (VH) comprising a VHCDR1 amino acid sequence chosen from SEQ ID NO: 1, SEQ ID NO: 4, or SEQ ID NO: 224; a VHCDR2 amino acid sequence of SEQ ID NO: 2 or SEQ ID NO: 5; and a VHCDR3 amino acid sequence of SEQ ID NO: 3; and (ii) a light chain variable region (VL) comprising a VLCDR1 amino acid sequence of SEQ ID NO: 10 or SEQ ID NO: 13, a VLCDR2 amino acid sequence of SEQ ID NO: 11 or SEQ ID NO: 14, and a VLCDR3 amino acid sequence of SEQ ID NO: 32 or SEQ ID NO: 33, each disclosed in Table 1 of US 2015/0210769.

In certain embodiments, the anti-PD-1 antibody molecule is administered by injection (e.g., subcutaneously or intravenously) at a dose of about 1 to 30 mg/kg, e.g., about 5 to 25 mg/kg, about 10 to 20 mg/kg, about 1 to 5 mg/kg, or about 3 mg/kg. The dosing schedule can vary from e.g., once a week to once every 2, 3, or 4 weeks. In one embodiment, the anti-PD-1 antibody molecule is administered at a dose from about 1 to 20 mg/kg every other week.

In some embodiments, the dose of a PD-1 inhibitor, e.g., an anti-PD-1 antibody molecule, is a flat dose. In some embodiments, the anti-PD-1 antibody molecule is administered by injection (e.g., subcutaneously or intravenously) at a dose (e.g., a flat dose) of about 200 mg to 500 mg, e.g., about 250 mg to 450 mg, about 300 mg to 400 mg, about 250 mg to 350 mg, about 350 mg to 450 mg, or about 300 mg or about 400 mg. The dosing schedule (e.g., flat dosing schedule) can vary from e.g., once a week to once every 2, 3, 4, 5, or 6 weeks. In one embodiment, the anti-PD-1 antibody molecule is administered at a dose from about 300 mg to 400 mg once every three weeks or once every four weeks. In one embodiment, the anti-PD-1 antibody molecule is administered at a dose from about 300 mg once every three weeks. In one embodiment, the anti-PD-1 antibody molecule is administered at a dose from about 400 mg once every four weeks, e.g., via i.v. infusion. In one embodiment, the anti-PD-1 antibody molecule is administered at a dose from about 300 mg once every four weeks, e.g., via i.v. infusion. In one embodiment, the anti-PD-1 antibody molecule is administered at a dose from about 400 mg once every three weeks, e.g., via i.v. infusion.

In another embodiment, the anti-PD-L1 antibody molecule includes at least one, two, three, four, five or six CDRs (or collectively all of the CDRs) from a heavy and light chain variable region of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1, or encoded by a nucleotide sequence shown in Table 1 of US-2016/0108123. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-L1 antibody molecule includes at least one or two heavy chain variable domain (optionally including a constant region), at least one or two light chain variable domain (optionally including a constant region), or both, comprising the amino acid sequence of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1 of US-2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In one embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 2; and a VHCDR3 amino acid sequence of SEQ ID NO: 3, each disclosed in Table 1 of US-2016/0108123; and (ii) a light chain variable region (VL) including a VLCDR1 amino acid sequence of SEQ ID NO: 9, a VLCDR2 amino acid sequence of SEQ ID NO: 10, and a VLCDR3 amino acid sequence of SEQ ID NO: 11, each disclosed in Table 1 of US-2016/0108123.

In another embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 5, and a VHCDR3 amino acid sequence of SEQ ID NO: 3, each disclosed in Table 1 of US-2016/0108123; and (ii) a light chain variable region (VL) including a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Table 1 of US-2016/0108123.

In one embodiment, the anti-PD-L1 antibody molecule comprises the VHCDR1 amino acid sequence of SEQ ID NO: 1. In another embodiment, the anti-PD-L1 antibody molecule comprises the VHCDR1 amino acid sequence of SEQ ID NO: 4. In yet another embodiment, the anti-PD-L1 antibody molecule comprises the VHCDR1 amino acid sequence of SEQ ID NO: 195, each disclosed in Table 1 of US-2016/0108123.

TIM3 (T cell immunoglobulin-3) also negatively regulates T cell function, particularly in IFN-g-secreting CD4+ T helper 1 and CD8+ T cytotoxic 1 cells, and plays a critical role in T cell exhaustion. Inhibition of the interaction between TIM3 and its ligands, e.g., galectin-9 (Gal9), phosphotidylserine (PS), and HMGB1, can increase immune response. Antibodies, antibody fragments, and other inhibitors of TIM3 and its ligands are available in the art and may be used combination with a CD19 CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In one embodiment, the anti-TIM3 antibody or fragment thereof is an anti-TIM3 antibody molecule as described in US 2015/0218274, entitled "Antibody Molecules to TIM3 and Uses Thereof," incorporated by reference in its entirety. In one embodiment, the anti-TIM3 antibody molecule includes at least one, two, three, four, five or six CDRs (or collectively all of the CDRs) from a heavy and light chain variable region from an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3- hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-TIM3 antibody molecule comprises at least one, two, three or four variable regions from an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In other embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. *PLoS One.* 2010 Sep. 2; 5(9). pii: e12529 (DOI:10.1371/journal.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. *J Immunol.* 2002 Mar. 15; 168(6): 2803-10; Markel et al. *J Immunol.* 2006 Nov. 1; 177(9): 6062-71; Markel et al. *Immunology.* 2009 February; 126(2): 186-200; Markel et al. *Cancer Immunol Immunother.* 2010 February; 59(2):215-30; Ortenberg et al. *Mol Cancer Ther.* 2012 June; 11(6):1300-10; Stern et al. *J Immunol.* 2005 Jun. 1; 174(11):6692-701; Zheng et al. *PLoS One.* 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) Nature doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CD19 CAR described herein. For example, BMS-986016 (Bristol-Myers Squib) is a monoclonal antibody that targets LAG3. IMP701 (Immutep) is an antagonist LAG3 antibody and IMP731 (Immutep and GlaxoSmithKline) is a depleting LAG3 antibody. Other LAG3 inhibitors include IMP321 (Immutep), which is a recombinant fusion protein of a soluble portion of LAG3 and Ig that binds to MHC class II molecules and activates antigen presenting cells (APC). Other antibodies are disclosed, e.g., in W 02010/019570.

In one embodiment, the anti-LAG3 antibody or fragment thereof is an anti-LAG3 antibody molecule as described in US 2015/0259420, entitled "Antibody Molecules to LAG3 and Uses Thereof," incorporated by reference in its entirety. In one embodiment, the anti-LAG3 antibody molecule includes at least one, two, three, four, five or six CDRs (or collectively all of the CDRs) from a heavy and light chain variable region from an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Table 1; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-LAG3 antibody molecule comprises at least one, two, three or four variable regions from an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050- hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Tables 1; or a sequence substantially identical (e.g., at least 80%, 85%, 90%, 92%, 95%, 97%, 98%, 99% or higher identical) to any of the aforesaid sequences.

In some embodiments, the agent which enhances the activity of a CAR-expressing cell can be, e.g., a fusion protein comprising a first domain and a second domain, wherein the first domain is a checkpoint molecule, or fragment thereof, and the second domain is a polypeptide that is associated with a positive signal, e.g., a polypeptide comprising an intracellular signaling domain as described herein (also referred to herein as an inhibitory CAR or iCAR). In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell that does not express a CAR, e.g., a CD19 CAR.

In one embodiment, the extracellular domain (ECD) of a checkpoint molecule, e.g., a checkpoint molecule described herein such as, e.g., Programmed Death 1 (PD1), can be fused to a transmembrane domain and intracellular signaling domain described herein, e.g., an intracellular signaling domain comprising a costimulatory signaling domain such as, e.g., 41BB OX40, Cd28, CD27, and/or a primary signaling domain, e.g., of CD3 zeta. In one embodiment, the inhibitory CAR, e.g., e.g., PD1 CAR, can be used in combination with another CAR, e.g., CD19CAR (e.g., a CD19RCAR). In one embodiment, the PD1 RCAR (or PD1 CAR) improves the persistence of the T cell. Examples of inhibitory molecules include PD1, PD-L1, PD-L2, CTLA4, TIM3, CEACAM (e.g., CEACAM-1, CEACAM-3, and/or CEACAM-5), LAG3, VISTA, BTLA, TIGIT, LAIR1, CD160, 2B4 and TGF (e.g., TGF beta). In one embodiment, the inhibitory molecule CAR comprises a first polypeptide, e.g., of an inhibitory molecule such as PD1, PD-L1, PD-L2, CTLA4, TIM3, CEACAM (e.g., CEACAM-1, CEACAM-3, and/or CEACAM-5), LAG3, VISTA, BTLA, TIGIT, LAIR1, CD160, 2B4 and TGF (e.g., TGF beta), or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein).

In one embodiment, the inhibitory molecule CAR comprises the extracellular domain (ECD) of PD1 fused to a transmembrane domain and intracellular signaling domains such as 41BB and CD3 zeta (also referred to herein as a PD1 CAR). In one embodiment, the PD1 CAR improves the persistence of the cell CAR-expressing cell. In one embodiment, the PD1 CAR comprises the extracellular domain of PD1 indicated as underlined in SEQ ID NO: 40. In one embodiment, the PD1 CAR comprises, the amino acid sequence of SEQ ID NO:40.

(SEQ ID NO: 40)
Malpvtalllplalllhaarppgwfldspdrpwnpptfspallvvtegdn atftcsfsntsesfvlnwyrmspsnqtdklaafpedrsqpgqdcrfrvtq lpngrdfhmsvvrarrndsgtylcgaislapkaqikeslraelrvterra evptahpspsprpagqfqtlvttpaprpptpaptiasqplslrpeacrp aaggavhtrgldfacdiyiwaplagtcgvlllslvitlyckrgrkkllyi fkqpfmrpvqttqeedgcscrfpeeeeggcelrvkfsrsadapaykqgqn qlynelnlgrreeydvldkrrgrdpemggkprrknpqeglynelqkdkma eayseigmkgerrrgkghdglyqglstatkdtydalhmqalppr In one embodiment, the PD1 CAR comprises the amino acid sequence provided below.

(SEQ ID NO: 41)
pqwfldspdrpwnpptfspallvvtegdnatftcsfsntsesfvlnwyrm spsnqtdklaafpedrsqpgqdcrfrvtqlpngrdfhmsvvrarrndsgt ylcgaislapkaqikeslraelrvterraevptahpspsprpagqfqtlv tttpaprpptpaptiasqplslrpeacrpaaggavhtrgldfacdiyiwa plagtcgvlllslvitlyckrgrkkllyifkqpfmrpvqttqeedgcscr fpeeeeggcelrvkfsrsadapaykqgqnqlynelnlgrreeydvldkrr grdpemggkprrknpqeglynelqkdkmaeayseigmkgerrrgkghdgl yqglstatkdtydalhmqalppr In one embodiment, the PD1 CAR, e.g., the PD1 CAR described herein, is encoded by a nucleic acid sequence shown below, or at least the comprises the nucleic acid sequence encoding the extracellular domain of PD1 (shown in underline below).

(SEQ ID NO: 42)
atggccctccctgtcactgccctgcttctcccctcgcactcctgctcca cgccgctagacacccggatggtttctggactctccggatcgcccgtgga atcccccaaccttctcaccggcactcttggttgtgactgagggcgataat gcgaccttcacgtgctcgttctccaacacctccgaatcattcgtgctgaa ctggtaccgcatgagcccgtcaaaccagaccgacaagctcgccgcgtttc cggaagatcggtcgcaaccgggacaggattgtcggttccgcgtgactcaa ctgccgaatggcagagacttccacatgagcgtggtccgcgctaggcgaaa cgactccgggacctacctgtgcggagccatctcgctggcgcctaaggccc aaatcaaagagagcttgagggccgaactgagagtgaccgagcgcagagct gaggtgccaactgcacatccatcccatcgcctcggcctgcggggcagtt tcagaccctggtcacgaccactccggcgccgcgcccaccgactccggccc caactatcgcgagccagccctgtcgctgaggccggaagcatgccgccct gccgccggaggtgctgtgcatacccggggattggacttcgcatgcgacat ctacatttgggctcctctcgccggaacttgtggcgtgctccttctgtccc tggtcatcaccctgtactgcaagcggggtcggaaaaagcttctgtacatt ttcaagcagccctttcatgaggcccgtgcaaaccaccaggaggaggacgg ttgctcctgccggttccccgaagaggaagaaggaggttgcgagctgcgcg -continued

```
tgaagttctcccggagcgccgacgccccgcctataagcagggccagaac cagctgtacaacgaactgaacctgggacggcgggaagagtacgatgtgct ggacaagcggcgcggccgggaccccgaaatgggcgggaagcctagaagaa agaaccctcaggaaggcctgtataacgagctgcagaaggacaagatggcc gaggcctactccgaaattgggatgaagggagagcggcggaggggaaggg gcacgacggcctgtaccaaggactgtccaccgccaccaaggacacatacg atgccctgcacatgcaggccttcccctcgc
```

In embodiments, the inhibitory extracellular domain has at least 70, 75, 80, 85, 90, 95, 96, 97, 98, or 99% identity with, or differs by no more than 30, 25, 20, 15, 10, 5, 4, 3, 2, or 1 amino acid residues from the corresponding residues of a naturally occurring human inhibitory molecule, e.g., a naturally occurring human primary stimulatory molecule disclosed herein.

Strategies for Regulating Chimeric Antigen Receptors

There are many ways CAR activities can be regulated. In embodiments, a CRS therapy herein is used in combination with a strategy for regulating chimeric antigen receptors as described in this section. For example, inducible apoptosis using, e.g., a caspase fused to a dimerization domain (see, e.g., Di Stasa et al., N Egnl. J. Med. 2011 Nov. 3; 365(18): 1673-1683), can be used as a safety switch in the CAR therapy of the instant invention. In one embodiment, the cells (e.g., T cells or NK cells) expressing a CAR of the present invention further comprise an inducible apoptosis switch, wherein a human caspase (e.g., caspase 9) or a modified version is fused to a modification of the human FKB protein that allows conditional dimerization. In the presence of a small molecule, such as a rapalog (e.g., AP 1903, AP20187), the inducible caspase (e.g., caspase 9) is activated and leads to the rapid apoptosis and death of the cells (e.g., T cells or NK cells) expressing a CAR of the present invention. Examples of a caspase-based inducible apoptosis switch (or one or more aspects of such a switch) have been described in, e.g., US2004040047; US20110286980; US20140255360; WO1997031899; WO2014151960; WO2014164348; WO2014197638; WO2014197638; all of which are incorporated by reference herein.

In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. Cancer Gene Ther. 2008; 15(10):667-75; Clinical Trial Id. No. NCT02107963; and Di Stasi et al. N. Engl. J. Med. 2011; 365:1673-83.

Alternative strategies for regulating CAR therapies include utilizing small molecules or antibodies that deactivate or turn off CAR activity, e.g., by depleting CAR-expressing cells, e.g., by inducing antibody dependent cell-mediated cytotoxicity (ADCC).

In one embodiment, the CAR therapy includes administration of a T cell depleting agent. In one embodiment, the T cell depleting agent is an agent that depletes CAR-expressing cells, e.g., by inducing antibody dependent cell-mediated cytotoxicity (ADCC) and/or complement-induced cell death. For example, CAR-expressing cells described herein may also express an antigen (e.g., a target antigen) that is recognized by molecules capable of inducing cell death, e.g., ADCC or complement-induced cell death. For example, CAR expressing cells described herein may also express a target protein (e.g., a receptor) capable of being targeted by an antibody or antibody fragment. Examples of such target proteins include, but are not limited to, EpCAM, VEGFR, integrins (e.g., integrins $\alpha v\beta 3$, $\alpha 4$, $\alpha I3/4\beta 3$, $\alpha 4\beta 7$, $\alpha 5\beta 1$, $\alpha v\beta 3$, $\alpha v$), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

In other embodiments, a CAR-expressing cell described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., Gene Ther. 2013; 20(8) 853-860). Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., Blood. 2014; 124(8)1277-1287). Other methods for depleting CAR-expressing cells described herein include administration of CAMPATH, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g., ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In other embodiments, a CAR-expressing cell described herein may also express a target protein recognized by the T cell depleting agent. In one embodiment, the target protein is CD20 and the T cell depleting agent is an anti-CD20 antibody, e.g., rituximab. In such embodiment, the T cell depleting agent is administered once it is desirable to reduce or eliminate the CAR-expressing cell, e.g., to mitigate the CAR induced toxicity. In other embodiments, the T cell depleting agent is an anti-CD52 antibody, e.g., alemtuzumab, as described in the Examples herein.

In some embodiments, the methods disclosed herein further include administering a T cell depleting agent after treatment with the cell (e.g., an immune effector cell as described herein), thereby reducing (e.g., depleting) the CAR-expressing cells (e.g., the CD19CAR-expressing cells). Such T cell depleting agents can be used to effectively deplete CAR-expressing cells (e.g., CD19CAR-expressing cells) to mitigate toxicity. In some embodiments, the CAR-expressing cells were manufactured according to a method herein, e.g., assayed (e.g., before or after transfection or transduction) according to a method herein.

In some embodiments, the T cell depleting agent is administered one, two, three, four, or five weeks after administration of the cell, e.g., the population of immune effector cells, described herein.

In some embodiments, the CAR expressing cell co-expresses the CAR and the target protein, e.g., naturally expresses the target protein or is engineered to express the target protein. For example, the cell, e.g., the population of immune effector cells, can include a nucleic acid (e.g., vector) comprising the CAR nucleic acid (e.g., a CAR nucleic acid as described herein) and a nucleic acid encoding the target protein.

In one embodiment, the T cell depleting agent is a CD52 inhibitor, e.g., an anti-CD52 antibody molecule, e.g., alemtuzumab.

In other embodiments, the cell, e.g., the population of immune effector cells, expresses a CAR molecule as described herein (e.g., CD19CAR) and the target protein recognized by the T cell depleting agent. In one embodiment, the target protein is CD20. In embodiments where the target protein is CD20, the T cell depleting agent is an anti-CD20 antibody, e.g., rituximab.

In further embodiments of any of the aforesaid methods, the methods further include transplanting a cell, e.g., a hematopoietic stem cell, or a bone marrow, into the subject.

In another aspect, the invention features a method of conditioning a subject prior to cell transplantation. The method includes administering to the subject an effective amount of the cell comprising a CAR nucleic acid or polypeptide, e.g., a CD19 CAR nucleic acid or polypeptide. In some embodiments, the cell transplantation is a stem cell transplantation, e.g., a hematopoietic stem cell transplantation, or a bone marrow transplantation. In other embodiments, conditioning a subject prior to cell transplantation includes reducing the number of target-expressing cells in a subject, e.g., CD19-expressing normal cells or CD19-expressing cancer cells.

RCARs

In other embodiments, a regulatable CAR (RCAR) where the CAR activity can be controlled is desirable to optimize the safety and efficacy of a CAR therapy.

In an aspect, a RCAR comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. In one embodiment, a CAR of the present invention utilizes a dimerization switch as those described in, e.g., WO2014127261 or WO2015090229, which are incorporated by reference herein. Additional description and exemplary configurations of such regulatable CARs are provided herein and in, e.g., paragraphs 527-551 of International Publication No. WO 2015/090229 filed Mar. 13, 2015, which is incorporated by reference in its entirety.

Natural Killer Cell Receptor (NKR) CARs

In an embodiment, the CAR molecule described herein comprises one or more components of a natural killer cell receptor (NKR), thereby forming an NKR-CAR. The NKR component can be a transmembrane domain, a hinge domain, or a cytoplasmic domain from any of the following natural killer cell receptors: killer cell immunoglobulin-like receptor (KIR), e.g., KIR2DL1, KIR2DL2/L3, KIR2DL4, KIR2DL5A, KIR2DL5B, KIR2DS1, KIR2DS2, KIR2DS3, KIR2DS4, DIR2DS5, KIR3DL1/S1, KIR3DL2, KIR3DL3, KIR2DP1, and KIR3DP1; natural cytotoxicity receptor (NCR), e.g., NKp30, NKp44, NKp46; signaling lymphocyte activation molecule (SLAM) family of immune cell receptors, e.g., CD48, CD229, 2B4, CD84, NTB-A, CRACC, BLAME, and CD2F-10; Fc receptor (FcR), e.g., CD16, and CD64; and Ly49 receptors, e.g., LY49A, LY49C. The NKR-CAR molecules described herein may interact with an adaptor molecule or intracellular signaling domain, e.g., DAP12. Exemplary configurations and sequences of CAR molecules comprising NKR components are described in International Publication No. WO2014/145252, the contents of which are hereby incorporated by reference.

Split CAR

In some embodiments, the CAR-expressing cell comprises a split CAR. The split CAR approach is described in more detail in publications WO2014/055442 and WO2014/055657. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

Subset Optimized CARs

In some aspects and embodiments, the compositions and methods herein are optimized for a specific subset of T cells, e.g., as described in US Serial No. PCT/US2015/043219 filed Jul. 31, 2015, the contents of which are incorporated herein by reference in their entirety. In some embodiments, the optimized subsets of T cells display an enhanced persistence compared to a control T cell, e.g., a T cell of a different type (e.g., CD8+ or CD4+) expressing the same construct. In some embodiments, a CD4+ T cell comprises a CAR described herein, which CAR comprises an intracellular signaling domain suitable for (e.g., optimized for, e.g., leading to enhanced persistence in) a CD4+ T cell, e.g., an ICOS domain. In some embodiments, a CD8+ T cell comprises a CAR described herein, which CAR comprises an intracellular signaling domain suitable for (e.g., optimized for, e.g., leading to enhanced persistence of) a CD8+ T cell, e.g., a 4-1BB domain, a CD28 domain, or another costimulatory domain other than an ICOS domain. In some embodiments, the CAR described herein comprises an antigen binding domain described herein, e.g., a CAR comprising an antigen binding domain.

Pharmaceutical Compositions and Treatments

Pharmaceutical compositions may comprise a CAR-expressing cell, e.g., a plurality of CAR-expressing cells, as described herein, or a CRS therapy, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions can be, e.g., formulated for intravenous administration.

Pharmaceutical compositions of the present disclosure may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, mycoplasma, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis*, *Candida albicans*, *Escherichia coli*, *Haemophilus influenza*, *Neisseria meningitides*, *Pseudomonas aeruginosa*, *Staphylococcus aureus*, *Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., NEW ENG. J. OF MED. 319:1676, 1988).

In embodiments, the dosage of immune effector cells (e.g., T cells, NK cells) administered to a subject is altered depending on the risk status of the subject for developing severe CRS (e.g., risk status determined using a method described herein). In embodiments, the dosage of immune effector cells (e.g., T cells, NK cells) administered to a subject is lower in a subject identified as at high risk for developing severe CRS than a subject identified as at low risk for developing severe CRS. In embodiments, the dosage of immune effector cells (e.g., T cells, NK cells) administered to a subject identified as at high risk for developing severe CRS is $10^4$ to $10^8$ cells/kg body weight, in some instances $10^4$ to $10^7$, $10^4$ to $10^6$, $10^5$ to $10^7$, or $10^5$ to $10^6$ cells/kg body weight, including all integer values within those ranges. In embodiments, the dosage of immune effector cells (e.g., T cells, NK cells) administered to a subject identified as at low risk of developing severe CRS is $10^4$ to $10^9$ cells/kg body weight, in some instances $10^5$ to $10^6$ cells/kg body weight, including all integer values within those ranges.

In certain aspects, it may be desired to administer activated immune effector cells (e.g., T cells, NK cells) to a subject and then subsequently redraw blood (or have an apheresis performed), activate immune effector cells (e.g., T cells, NK cells) therefrom according to the present disclosure, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc. The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the T cell compositions described herein are administered to a patient by intradermal or subcutaneous injection. In one aspect, the T cell compositions described herein are administered by i.v. injection. The compositions of immune effector cells (e.g., T cells, NK cells) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These T cell isolates may be expanded by methods known in the art and treated such that one or more CAR constructs described herein may be introduced, thereby creating a CAR T cell of the present disclosure. Subjects in need thereof may subsequently undergo standard treatment with high dose chemotherapy followed by peripheral blood stem cell transplantation. In certain aspects, following or concurrent with the transplant, subjects receive an infusion of the expanded CAR T cells described herein. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. The dose for CAMPATH, for example, will generally be in the range 1 to about 100 mg for an adult patient, usually administered daily for a period between 1 and 30 days. A suitable daily dose is 1 to 10 mg per day although in some instances larger doses of up to 40 mg per day may be used (described in U.S. Pat. No. 6,120,766).

In one embodiment, the CAR is introduced into immune effector cells (e.g., T cells, NK cells), e.g., using in vitro transcription, and the subject (e.g., human) receives an initial administration of CAR immune effector cells (e.g., T cells, NK cells) of the invention, and one or more subsequent administrations of the CAR immune effector cells (e.g., T cells, NK cells) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR immune effector cells (e.g., T cells, NK cells) described herein are administered to the subject (e.g., human) per week, e.g., 2, 3, or 4 administrations of the CAR immune effector cells (e.g., T cells, NK cells) of the invention are administered per week. In one embodiment, the subject (e.g., human subject) receives more than one administration of the CAR immune effector cells (e.g., T cells, NK cells) per week (e.g., 2, 3 or 4 administrations per week) (also referred to herein as a cycle), followed by a week of no CAR immune effector cells (e.g., T cells, NK cells) administrations, and then one or more additional administration of the CAR immune effector cells (e.g., T cells, NK cells) (e.g., more than one administration of the CAR immune effector cells (e.g., T cells, NK cells) per week) is administered to the subject. In another embodiment, the subject (e.g., human subject) receives more than one cycle of CAR immune effector cells (e.g., T cells, NK cells), and the time between each cycle is less than 10, 9, 8, 7, 6, 5, 4, or 3 days. In one embodiment, the CAR immune effector cells (e.g., T cells, NK cells) are administered every other day for 3 administrations per week. In one embodiment, the CAR immune effector cells (e.g., T cells, NK cells) described herein are administered for at least two, three, four, five, six, seven, eight or more weeks.

In embodiments, if a subject is identified (e.g., using the methods described herein) as being at high risk of developing severe CRS, the subject is administered an altered a CAR-expressing cell therapy at an altered schedule or time course. For example, the subject identified as being at high risk of developing severe CRS is administered a CAR-expressing cell therapy with low frequency (e.g., lower frequency than a subject identified as being a low risk of developing severe CRS). For example, the subject identified as being at high risk of developing severe CRS is administered a CAR-expressing cell therapy where the one or more subsequent administrations are administered at least 1 week (e.g., at least 1, 2, 3, 4, 5, or 6 weeks, or at least 1 month, 2 months, 3 months, or 3 months or more) after the previous administration. For example, the subject identified as being at high risk of developing severe CRS is administered a CAR-expressing cell therapy where the one or more subsequent administrations are administered at least 7 days (e.g., at least 7, 8, 9, 10, 11, 12, 13, 14, 15, 16, 17, 18, 19, or 20 days or more) after the previous administration.

In one aspect, CAR-expressing cells (e.g., T cells, NK cells) as described herein such as, e.g., CD19 CAR-expressing cells, e.g., CTL019 are generated using lentiviral viral vectors, such as lentivirus. CAR-expressing cells generated that way can have stable CAR expression.

In one aspect, CAR-expressing cells (e.g., T cells, NK cells) transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the cell by electroporation.

A potential issue that can arise in patients being treated using transiently expressing CAR cells, e.g, T cells (particularly with murine scFv bearing CAR-expressing cells (e.g., T cells, NK cells)) is anaphylaxis after multiple treatments. Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CAR-expressing cell (e.g., T cell, NK cell) infusion breaks should not last more than ten to fourteen days.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic. Exemplary biopolymers are described, e.g., in paragraphs 1004-1006 of International Application WO2015/142675, filed Mar. 13, 2015, which is herein incorporated by reference in its entirety.

Exemplary Computer System

Various computer systems can be specially configured to leverage information returned on potential CRS severity risk status (for example, CRS severity risk status as described herein such as, high risk or low risk). In some embodiments, the computer system can determine and present information on confidence levels associated with various biomarkers for CRS severity, e.g., biomarkers described herein. For example, the computer systems can evaluate whether a test conducted on a subject indicates a CRS severity risk status of high or low, along with a degree of confidence associated with the classification. In further examples, the system can provide an indication and/or recommendation on increasing the degree of confidence associated with the predicted classification. In an embodiment, the system can be configured to evaluate any tests and tested biomarkers that have been performed for a subject against another characteristic identified as independent and/or additive of the existing data. The system can determine when an additional biomarker would increase confidence associated with, for example, a change in CRS severity risk status. The system can recommend testing of any identified characteristic accordingly.

In some embodiments, an interactive system for identification, assessment and/or treatment of a subject having cancer (e.g., a hematological cancer such as ALL and CLL) can be provided. According to one embodiment, the system can be configured to accept user input regarding degree of confidence of a subject assessment. Responsive to the user entered degree of confidence, the system can determine test characteristics to include in an evaluation model. In one example, the system includes specification of independent indicators for disease activity in a subject (e.g., patient) population. The system can be configured to estimate a degree of confidence in a determination of disease activity (e.g., CRS severity) or a prediction of future disease activity (e.g., CRS severity) based on what independent biomarkers/indicators are used. The system can be further configured to determine and/or recommend various combinations of the determined independent biomarkers/indicators to improve a degree of confidence in an evaluation.

According to another aspect, a computer system can be specially configured to evaluate biomarkers/indicators of CRS severity risk status. The system can be configured to generate a multivariate model, wherein the multivariate model excludes correlated biomarkers/indicators. In some examples, the system can be configured to identify correlated biomarkers/indicators responsive to evaluating returned test results within a subject (e.g., patient) population having one or more of the biomarkers/indicators. For example, the system can execute regression model analysis to control for various parameters, including, for example, subject age, race, sex, and the presence of other biomarkers/indicators. Responsive to eliminating correlated biomarkers/indicators, the system can generate a model of one or more independent biomarkers/indicators. In some embodiments, the system can be configured to select various combinations of the one or more independent biomarkers/indicators and can further access evaluations (including, for example, evaluating the combination directly) to present information on a confidence level associated with respective selections. The system selected models can be used to generate an expected change in disease activity (e.g., CRS severity risk status) with the determined confidence level.

In an embodiment, the disclosure provides a system for evaluating a subject's risk for CRS (e.g., severe CRS), comprising:

at least one processor operatively connected to a memory, the at least one processor when executing is configured to:

acquire a value of severe CRS risk status in response to an immune cell based therapy, e.g., a CAR-expressing cell therapy (e.g., a CD19 CAR-expressing cell (e.g., T cell, NK cell) therapy) for the subject.

In embodiments, the value of severe CRS risk status comprises a measure of one, two, three, four, five, six, seven, eight, nine, ten, or more (e.g., all) of: (i) the level or activity of sgp130 or IFN-gamma or a combination thereof, in a subject, e.g., in a sample (e.g., a blood sample), e.g., wherein the subject is an adult or pediatric subject;

(ii) the level or activity of sgp130, IFN-gamma, or IL1Ra, or a combination thereof (e.g., a combination of any two or all three of sgp130, IFN-gamma, and IL1Ra), in a sample (e.g., a blood sample), e.g., wherein the subject is an adult or pediatric subject;

(iii) the level or activity of sgp130 or IFN-gamma or a combination thereof, in a sample (e.g., a blood sample), and the level of bone marrow disease in the subject, e.g., wherein the subject is a pediatric subject;

(iv) the level or activity of sgp130, IFN-gamma, or MIP1-alpha, or a combination thereof (e.g., a combination of any two or all three of sgp130, IFN-gamma, and MIP1-alpha), in a sample (e.g., a blood sample), e.g., wherein the subject is a pediatric subject;

(v) the level or activity of sgp130, MCP1, or eotaxin, or a combination thereof (e.g., a combination of any two or all three of sgp130, MCP1, or eotaxin), in the subject, e.g., in a sample (e.g., a blood sample), e.g., wherein the subject is an adult or a pediatric subject;

(vi) the level or activity of IL2, eotaxin, or sgp130, or a combination thereof (e.g., a combination of any two or all three of IL2, eotaxin, or sgp130), in the subject, e.g., in a sample (e.g., a blood sample), e.g., wherein the subject is an adult or a pediatric subject;

(vii) the level or activity of IFN-gamma, IL2, or eotaxin, or a combination thereof (e.g., a combination of any two or all three of IFN-gamma, IL2, or eotaxin), in the subject, e.g., in a sample (e.g., a blood sample), e.g., wherein the subject is a pediatric subject;

(viii) the level or activity of IL10 and the level of disease burden in the subject, or a combination thereof in a subject, e.g., in a sample (e.g., a blood sample), e.g., wherein the subject is a pediatric subject;

(ix) the level or activity of IFN-gamma or IL-13, or a combination thereof, in the subject, e.g., wherein the subject is a pediatric subject;

(x) the level or activity of IFN-gamma, IL-13, or MIP1-alpha, or a combination thereof (e.g., a combination of any two or all three of IFN-gamma, IL-13, and MIP1-alpha), in a sample (e.g., a blood sample), e.g., wherein the subject is a pediatric subject;

(xi) the level or activity of IFN-gamma or MIP1-alpha, or a combination thereof, in a sample (e.g., a blood sample), e.g., wherein the subject is a pediatric or adult subject; or (xii) the level or activity of a cytokine or cytokine receptor chosen from one or more of sTNFR2, IP10, sIL1R2, sTNFR1, M1G, VEGF, sILR1, TNFα, IFNα, GCSF, sRAGE, IL4, IL10, IL1R1, IFN-γ, IL6, IL8, sIL2Rα, sgp130, sIL6R, MCP1, MIP1α, MIP1β, and GM-CSF, or a combination thereof, in a sample (e.g., a blood sample), where the value is indicative of the subject's severe CRS risk status.

In an embodiment, responsive to a determination of the value of the subject's severe CRS risk status, methods described herein comprise performing one, two, three, four or more of: identifying the subject as having a high or low risk for developing severe CRS; recommending a selection or alteration of a dosing of a CAR-expressing cell therapy (e.g., a CD19 CAR-expressing cell therapy as described herein, such as, e.g., CTL019); recommending a selection or alteration of a schedule or time course of a CAR-expressing cell therapy; recommending administration of a therapy to treat CRS (e.g., an IL-6 inhibitor, such as tocilizumab, a vasoactive medication, a corticosteroid, an immunosuppressive agent, and/or mechanical ventilation; or recommending a selection of an alternative therapy (e.g., for a severe CRS subject, e.g., a standard of care for a particular cancer type, e.g., ALL or CLL).

Figure 10:
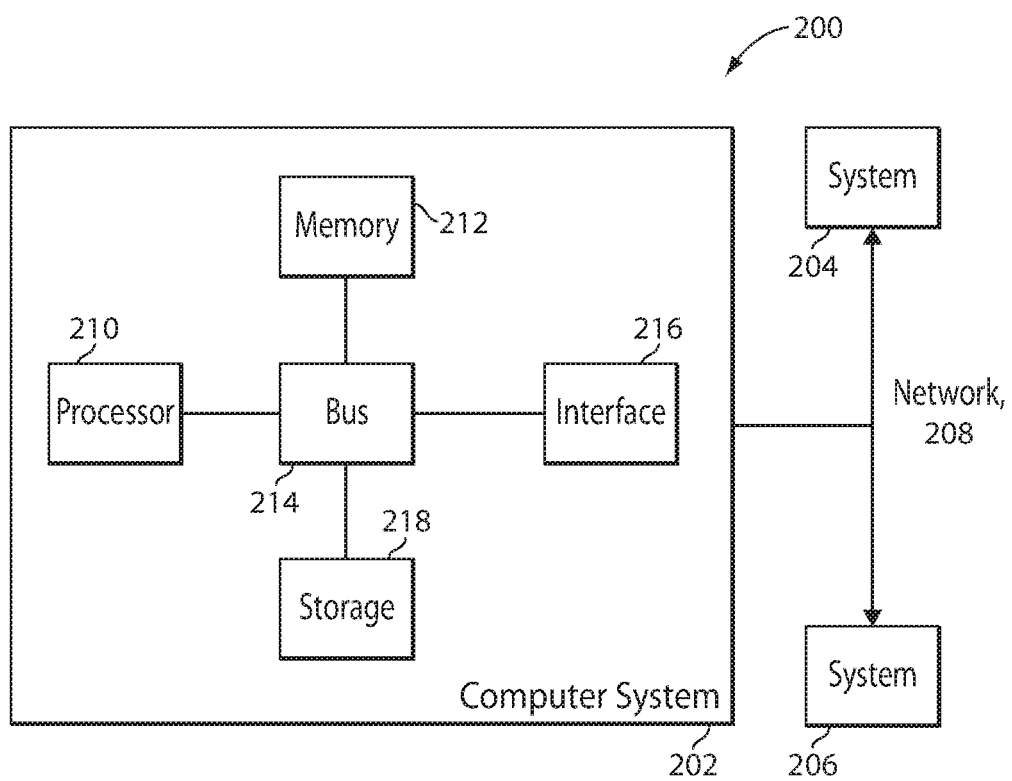
FIG. 10 depicts an exemplary block diagram of a computer system on which various aspects and embodiments may be practiced.
Figure 11A:
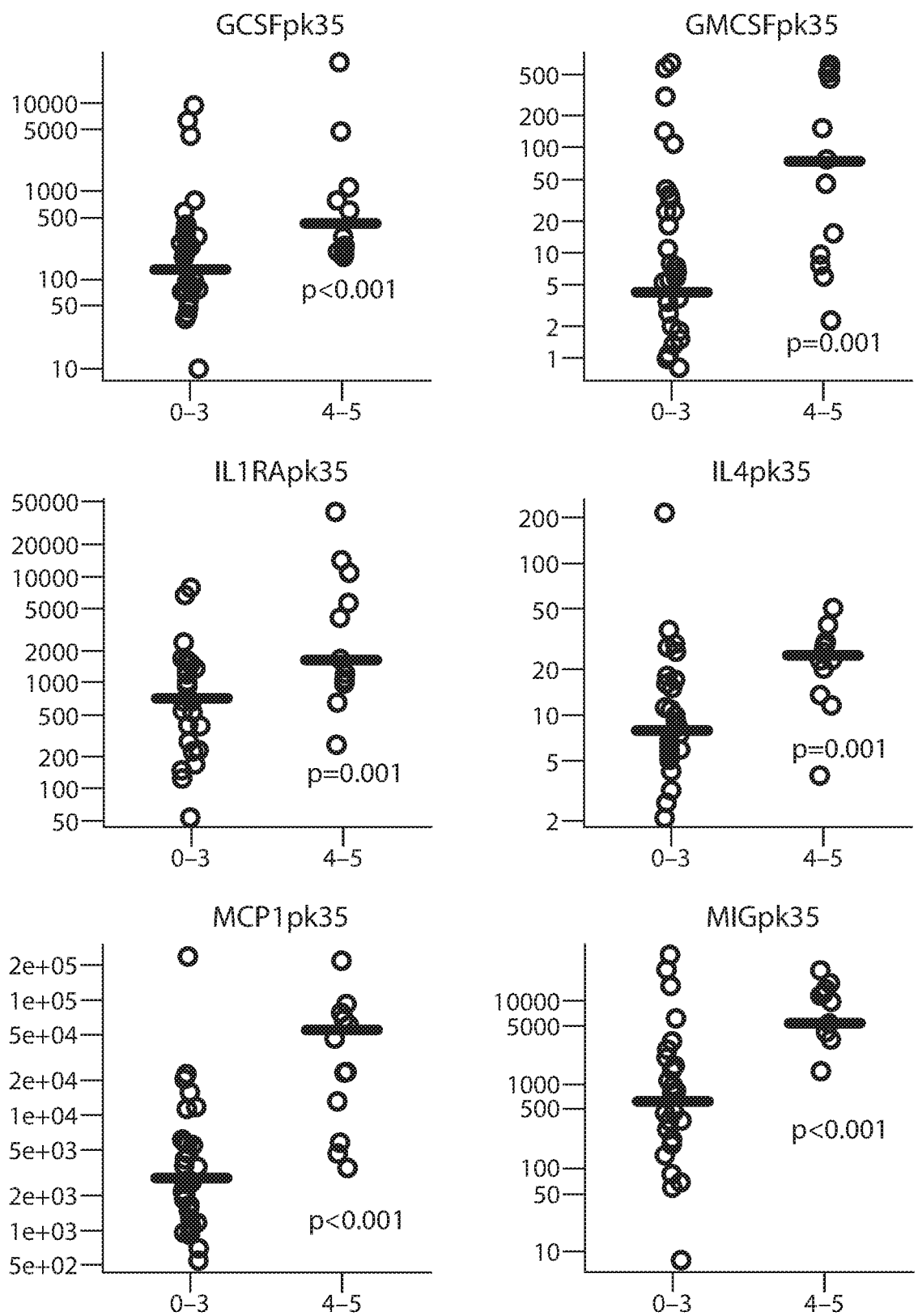
FIGS. 11A, 11B, 11C, and 11D depict peak levels of 24 cytokines during the first month after CTL019 infusion that are highly associated with CRS4-5 compared to CRS0-3, significant by the Holm-Bonferroni adjusted p-value. Serial cytokine assessment of 43 cytokines was performed in 51 patients treated with CTL019. Cytokine profiles were compared in patients who developed severe CRS with patients who did not. These figures depict peak values of cytokines over the first month. 24 cytokines, including IFNγ, IL6, IL8, sIL2Rα, sgp130, sIL6R, MCP1, MIP1α, and GM-CSF were highly associated with CRS4-5 compared to CRS0-3, significant by Holm's adjusted p-value.
Figure 11B:
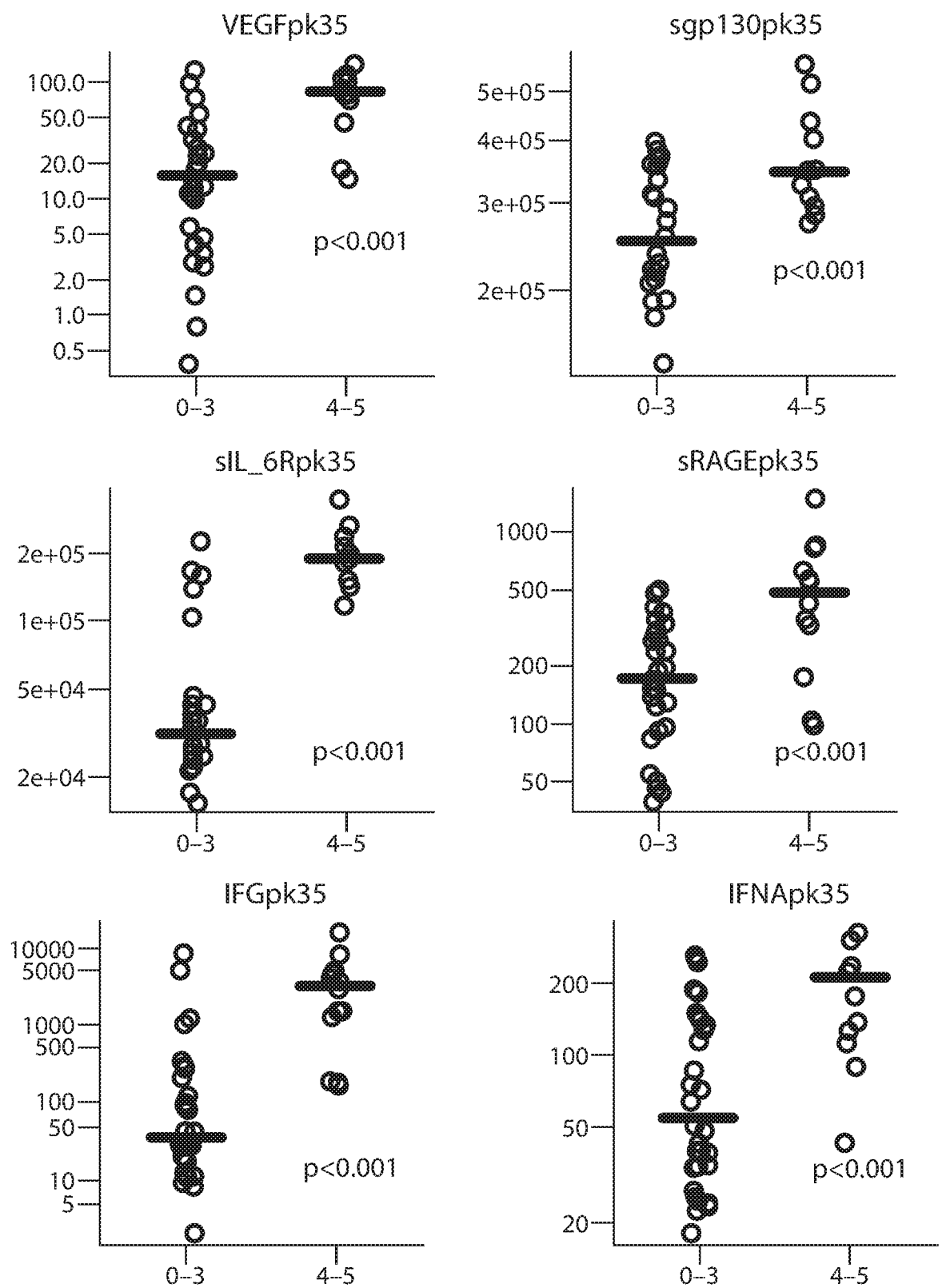
Figure 11C:
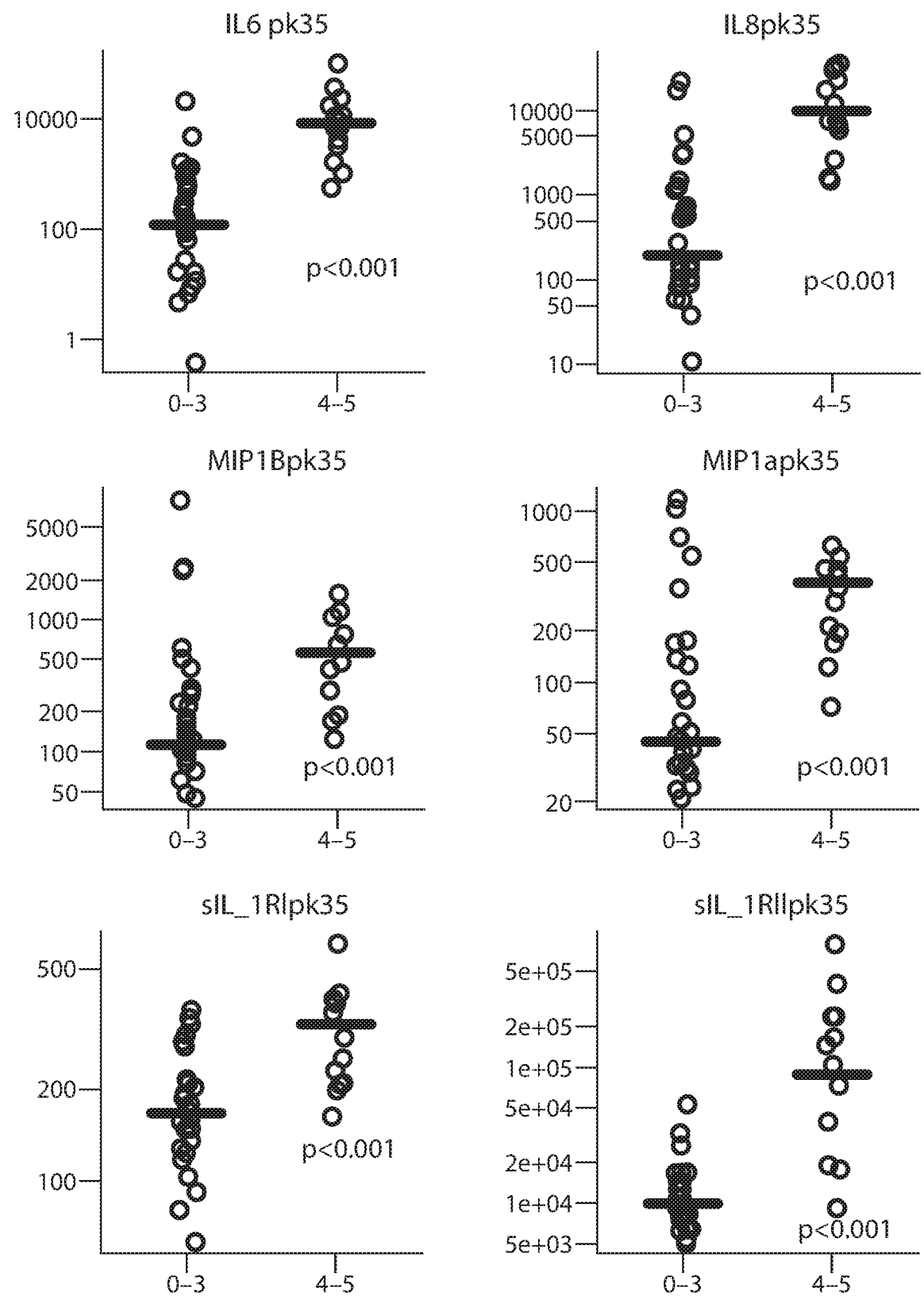
Figure 11D:
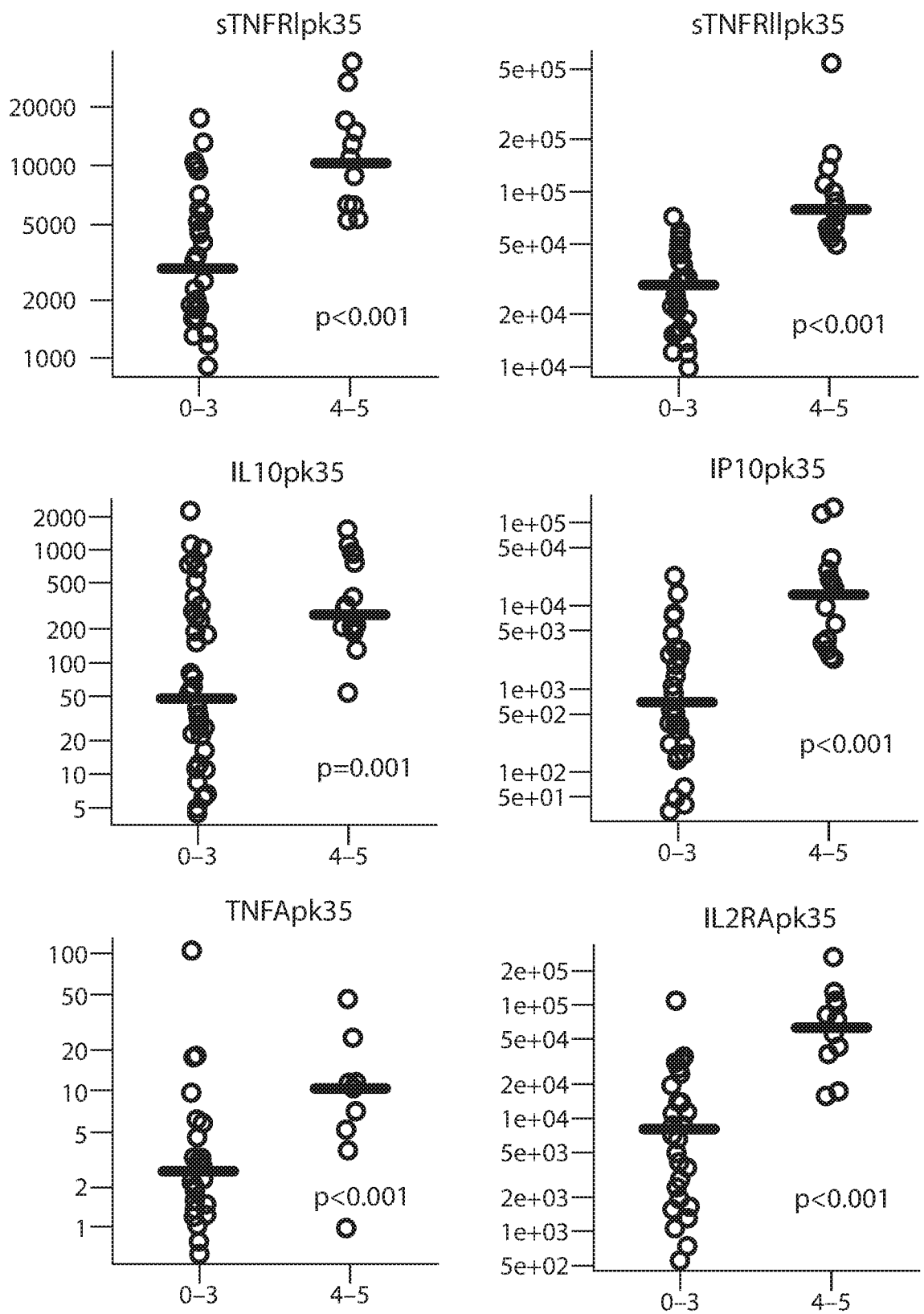
Figure 12A:
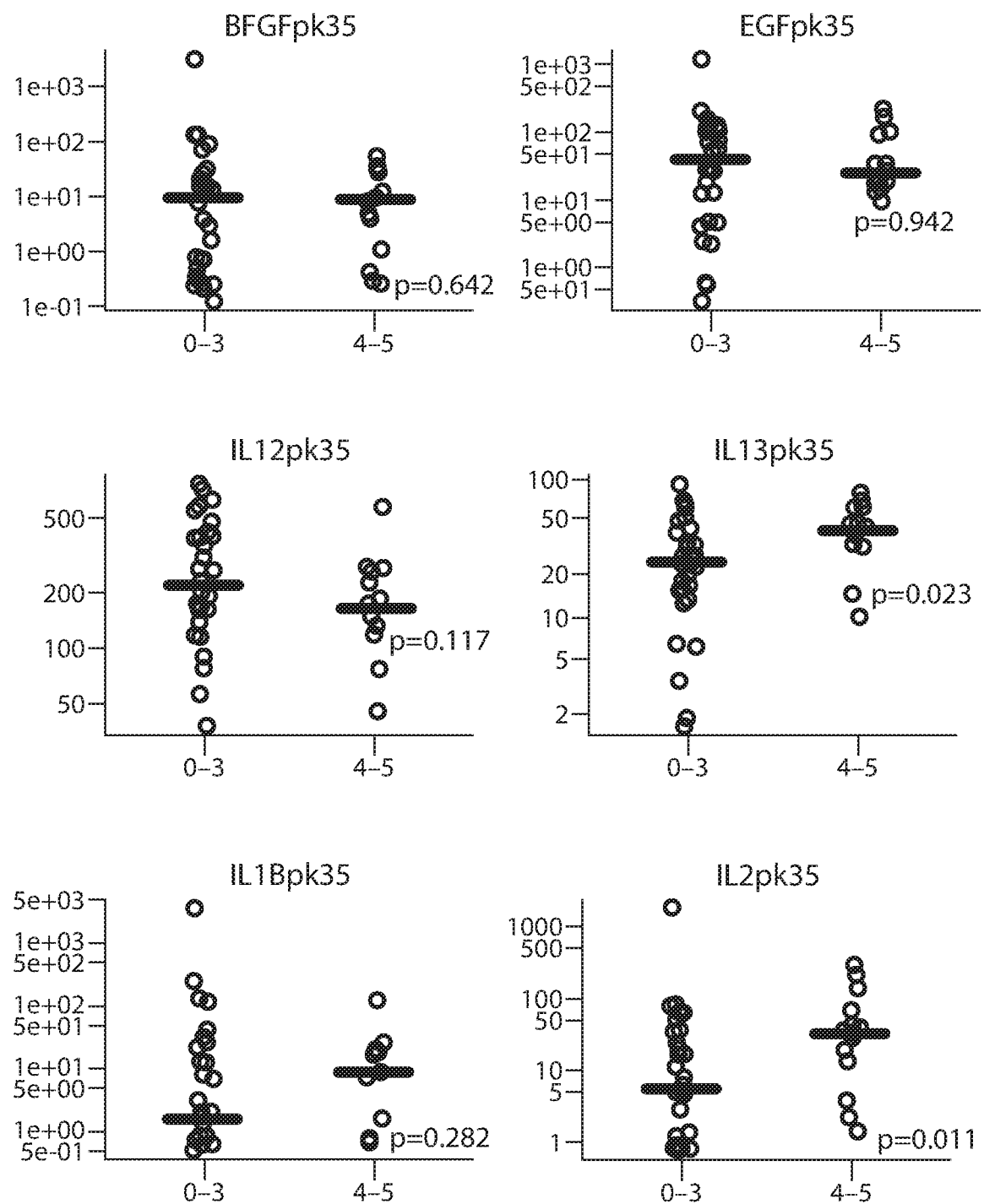
Figure 12B:
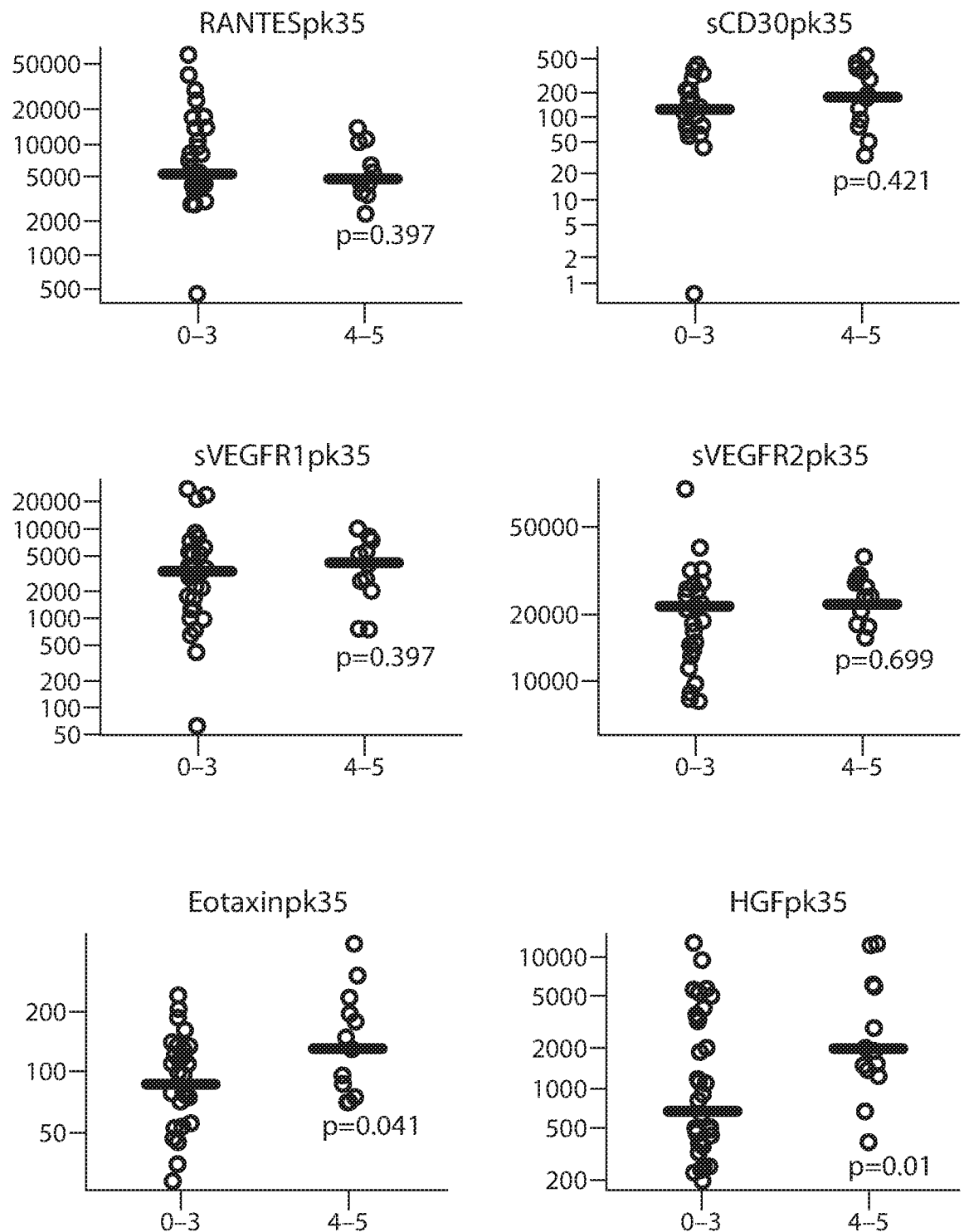
Figure 12C:
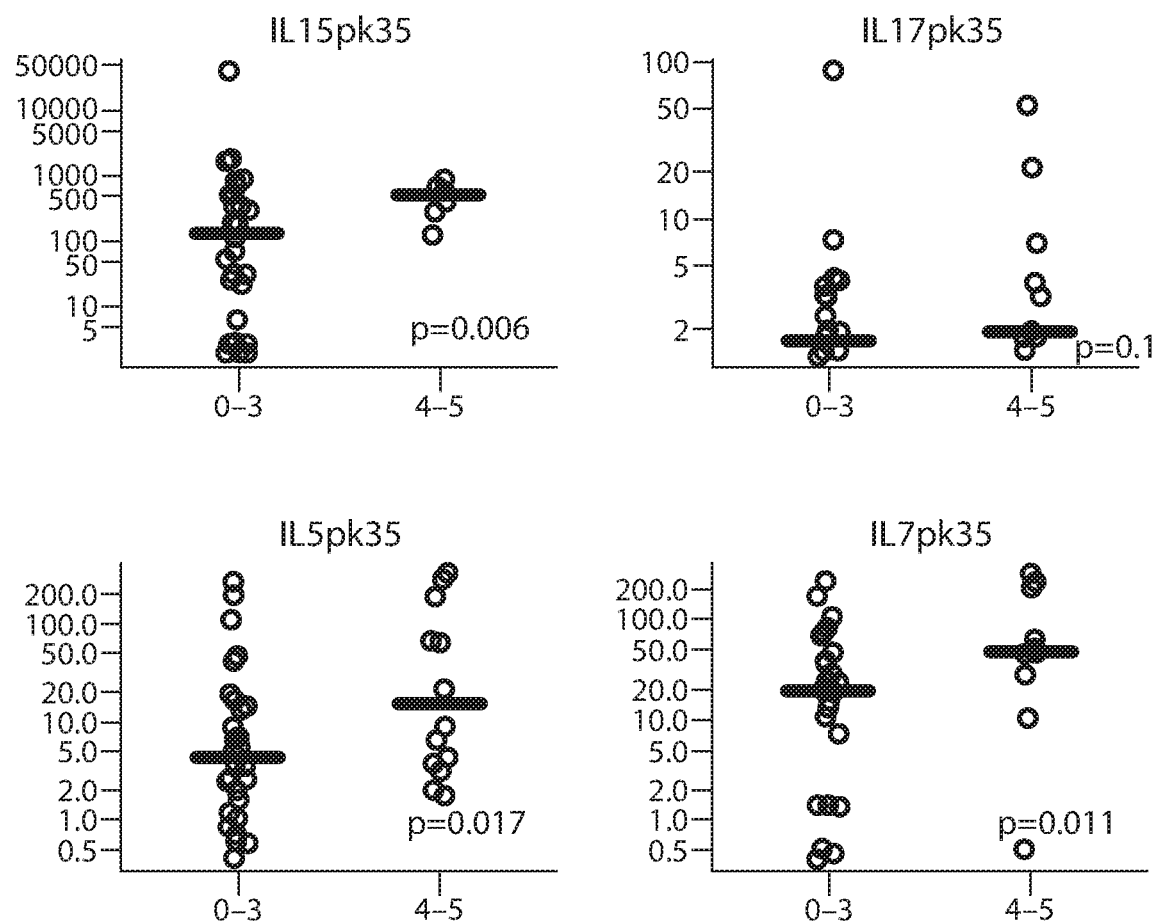
Figure 12D:
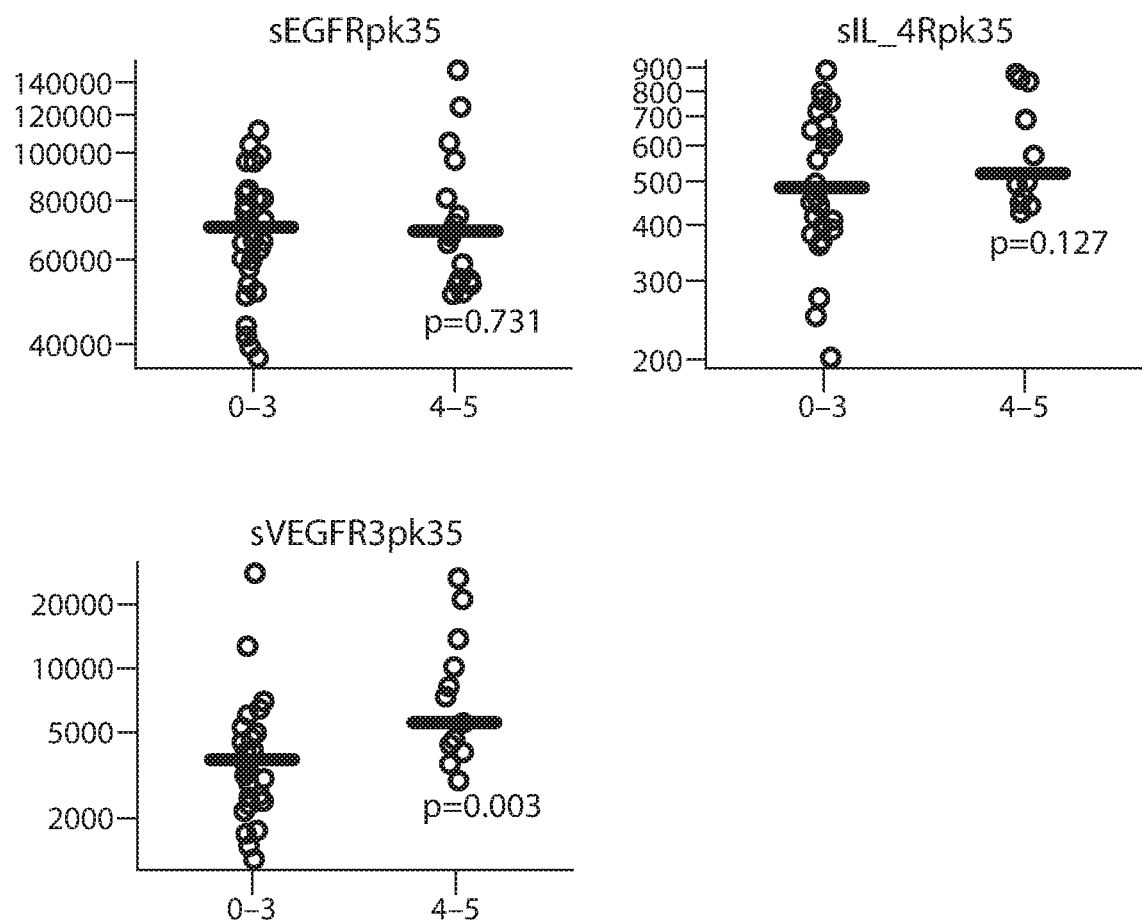

FIG. 10 is a block diagram of a distributed computer system 200, in which various aspects and functions in accord with the present disclosure may be practiced. The distributed computer system 200 may include one or more computer systems. For example, as illustrated, the distributed computer system 200 includes three computer systems 202, 204 and 206. As shown, the computer systems 202, 204 and 206 are interconnected by, and may exchange data through, a communication network 208. The network 208 may include any communication network through which computer systems may exchange data. To exchange data via the network 208, the computer systems 202, 204, and 206 and the network 208 may use various methods, protocols and standards including, among others, token ring, Ethernet, Wireless Ethernet, Bluetooth, radio signaling, infra-red signaling, TCP/IP, UDP, HTTP, FTP, SNMP, SMS, MMS, SS2, JSON, XML, REST, SOAP, CORBA IIOP, RMI, DCOM and Web Services.

According to some embodiments, the functions and operations discussed for evaluating (e.g., predicting) risk status for severe CRS in a subject can be executed on computer systems 202, 204 and 206 individually and/or in combination. For example, the computer systems 202, 204, and 206 support, for example, participation in a collaborative operations, which may include analyzing treatment data captured on a patient population. In one alternative, a single computer system (e.g., 202) can analyze treatment data captured on a subject (e.g., patient) population to develop characterization models and/or identify independent indicators for disease activity. The computer systems 202, 204 and 206 may include personal computing devices such as cellular telephones, smart phones, tablets, etc., and may also include desktop computers, laptop computers, etc.

Various aspects and functions in accord with the present disclosure may be implemented as specialized hardware or software executing in one or more computer systems including the computer system 202 shown in FIG. 10. In one embodiment, computer system 202 is a computing device specially configured to execute the processes and/or operations discussed above. For example, the system can present user interfaces to end-users that present treatment information, diagnostic information, and confidence levels associated with biomarkers, among other options. As depicted, the computer system 202 includes at least one processor 210 (e.g., a single core or a multi-core processor), a memory 212, a bus 214, input/output interfaces (e.g., 216) and storage 218. The processor 210, may include one or more microprocessors or other types of controllers, and can perform a series of instructions that manipulate data (e.g., treatment data, testing data, etc.). As shown, the processor 210 is connected to other system components, including a memory 212, by an interconnection element (e.g., the bus 214).

The memory 212 and/or storage 218 may be used for storing programs and data during operation of the computer system 202. For example, the memory 212 may be a relatively high performance, volatile, random access memory such as a dynamic random access memory (DRAM) or static memory (SRAM). In addition, the memory 212 may include any device for storing data, such as a disk drive or other non-volatile storage device, such as flash memory, solid state, or phase-change memory (PCM). In further embodiments, the functions and operations discussed with respect to evaluating (e.g., predicting) risk status of severe CRS in a subject can be embodied in an application that is executed on the computer system 202 from the memory 212 and/or the storage 218.

Computer system 202 also includes one or more interfaces 216 such as input devices, output devices, and combination input/output devices. The interfaces 216 may receive input, provide output, or both. The storage 218 may include a computer-readable and computer-writeable nonvolatile storage medium in which instructions are stored that define a program to be executed by the processor. The storage system 218 also may include information that is recorded, on or in, the medium, and this information may be processed by the application. A medium that can be used with various embodiments may include, for example, optical disk, magnetic disk or flash memory, SSD, among others.

Further, the invention is not limited to a particular memory system or storage system. Although the computer system 202 is shown by way of example as one type of computer system upon which various functions for evaluating (e.g., predicting) risk status for severe CRS in a subject may be practiced, aspects of the invention are not limited to being implemented on the computer system, shown in FIG. 10. Various aspects and functions in accord with the present invention may be practiced on one or more computers having different architectures or components than that shown in FIG. 10.

In some embodiments, the computer system 202 may include an operating system that manages at least a portion of the hardware components (e.g., input/output devices, touch screens, cameras, etc.) included in computer system 202. One or more processors or controllers, such as processor 210, may execute an operating system which may be, among others, a Windows-based operating system (e.g., Windows NT, ME, XP, Vista, 2, 8, or RT) available from the Microsoft Corporation, an operating system available from Apple Computer (e.g., MAC OS, including System X), one of many Linux-based operating system distributions (for example, the Enterprise Linux operating system available from Red Hat Inc.), a Solaris operating system available from Sun Microsystems, or a UNIX operating systems available from various sources. Many other operating systems may be used, including operating systems designed for personal computing devices (e.g., iOS, Android, etc.) and embodiments are not limited to any particular operating system.

According to one embodiment, the processor and operating system together define a computing platform on which applications may be executed. Additionally, various functions for evaluating (e.g., predicting) risk status for severe CRS in a subject may be implemented in a non-programmed environment (for example, documents created in HTML, XML or other format that, when viewed in a window of a browser program, render aspects of a graphical-user interface or perform other functions). Further, various embodiments in accord with aspects of the present disclosure may be implemented as programmed or non-programmed components, or any combination thereof. Thus, the disclosure is not limited to a specific programming language and any suitable programming language could also be used.

EXEMPLIFICATION

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples specifically point out various aspects of the present invention, and are not to be construed as limiting in any way the remainder of the disclosure.

Example 1: Biomarkers Accurately Predict Cytokine Release Syndrome (CRS) after Chimeric Antigen Receptor (CAR) T Cell Therapy for Acute Lymphoblastic Leukemia (ALL)

CAR T cells with anti-CD19 specificity have demonstrated considerable promise against highly refractory hematologic malignancies. Dramatic responses with complete remission rates as high as 90% have been reported in patients (pts) with relapsed/refractory ALL treated with CTL019 (Maude et al., NEJM 2014). Marked in vivo CAR T cell proliferation (100 to 100,000×) leads to improved efficacy but can be associated with adverse events, including cytokine release syndrome (CRS). To better understand manifestations of CRS, clinical, laboratory, and biomarker data of 39 children and 12 adults with relapsed/refractory ALL treated with anti-CD19 CAR T cells were studied.

T cells were lentivirally transduced with a CAR composed of anti-CD19 single chain variable fragment/4-1BB/

CD3 (Porter, NEJM 2011). 43 cytokines, chemokines, and soluble receptors (collectively termed cytokines in this example) were serially measured, using Luminex bead array. Other biomarkers were tested in a CLIA/CAP certified lab.

48 of 51 pts developed grade 1-5 CRS (CRS1-5) (see Table 13 below). Most patients developed mild (grade 1-2) to moderate (grade 3) CRS (34/51). 14 pts developed severe (grade 4-5) CRS (12 grade 4, 2 adults with grade 5). 21 pts were treated with the IL-6 inhibitor tocilizumab, and most had rapid marked clinical improvement in CRS evidenced by quick resolution of fever and weaning of vasoactive medications.

TABLE 13

CRS grading.

| | |
|---|---|
| Gr1 | Supportive care only |
| Gr2 | IV therapies +/- hospitalization. |
| Gr3 | Hypotension requiring IV fluids or low-dose vasoactives or hypoxemia requiring oxygen, CPAP, or BIPAP. |
| Gr4 | Hypotension requiring high-dose vasoactives or hypoxemia requiring mechanical ventilation. |
| Gr 5 | Death |

The analysis found peak levels of 24 cytokines, including IFN-gamma, IL6, IL8, sIL2Rα, sgp130, sIL6R, MCP1, MIP1α, and GM-CSF during the first month after CTL019 infusion were highly associated with severe CRS (CRS4-5) compared to CRS0-3, significant by the Holm-Bonferroni adjusted p-value (FIGS. 11A, 11B, 11C, and 11D). Cytokines that were not differentially elevated are shown in FIGS. 12A, 12B, 12C, and 12D.

Figure 1:
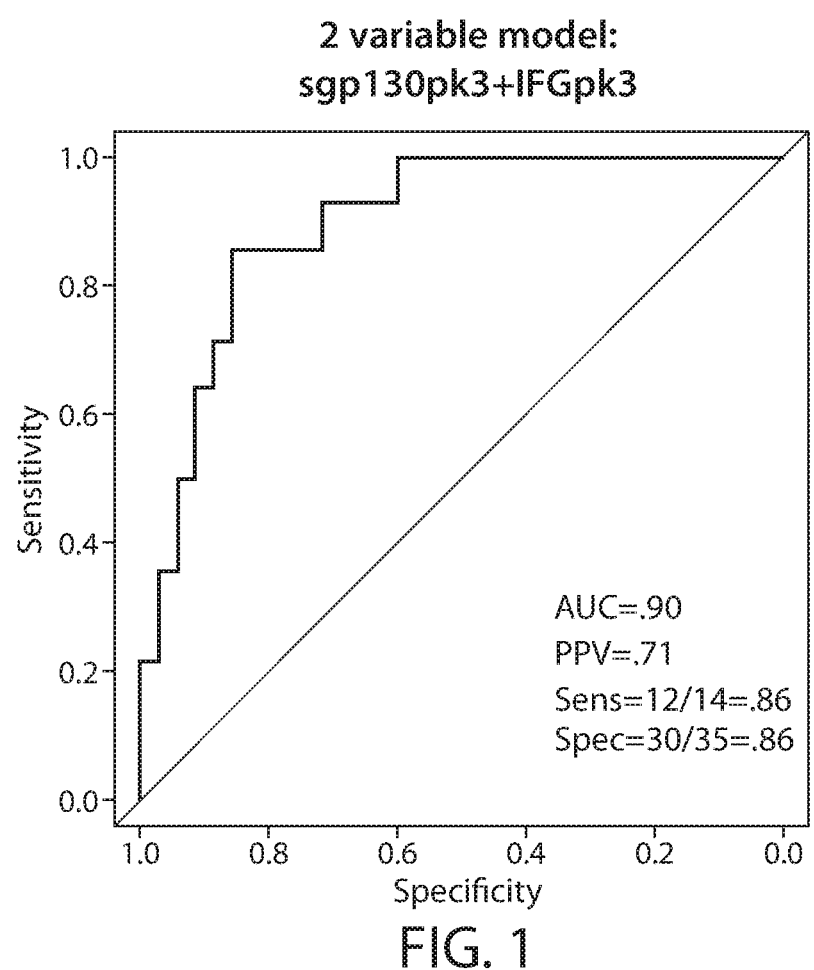
FIG. 1 depicts a receiver operating characteristic (ROC) curve illustrating the sensitivity and specificity of a two-gene panel (sgp130 and IFN-gamma) for predicting severe CRS. Sensitivity refers to the true positive rate; specificity refers to the false positive rate. PPV=positive prediction value (precision). Sens=12/14 indicates that there were 14 true positives and the test predicted 12 of them correctly. Spec=30/35 indicates that there were 35 true negatives and the test predicted 30 of them correctly.
Figure 2:
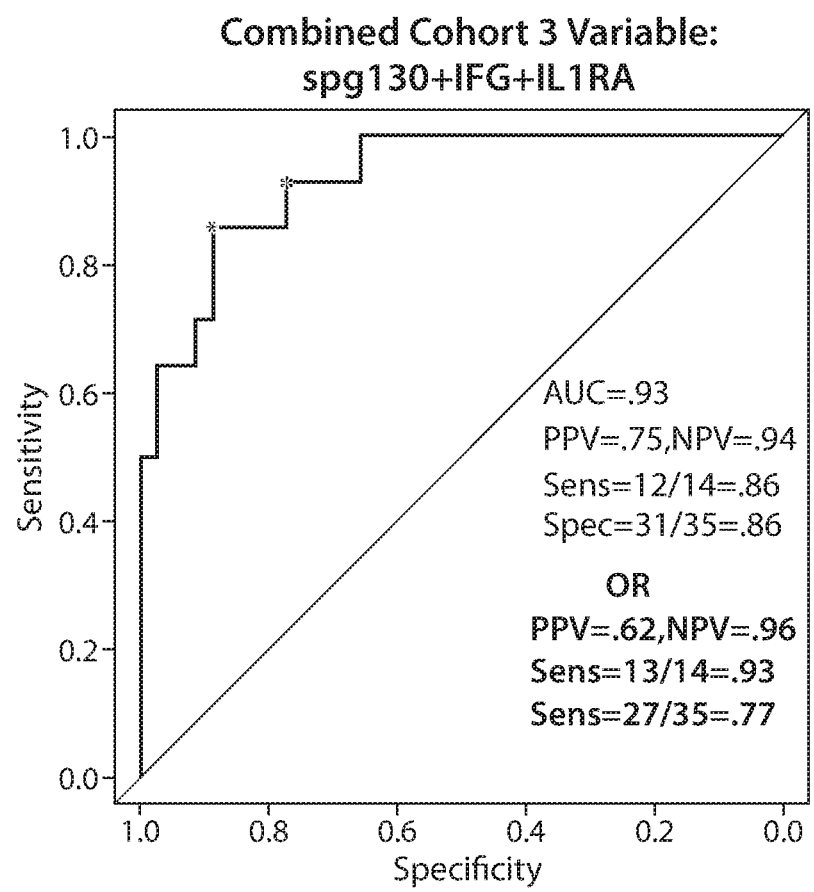
FIG. 2 depicts a ROC curve showing the sensitivity and specificity of a three-gene panel (sgp130, IFN-gamma, and IL1Ra) for predicting severe CRS in the combined cohort. Sensitivity refers to the true positive rate; specificity refers to the false positive rate. PPV=positive prediction value (precision). Sens=12/14 indicates that there were 14 true positives and the test predicted 12 of them correctly. Spec=31/35 indicates that there were 35 true negatives and the test predicted 31 of them correctly. An alternative analysis of the data shows sens=13/14 and spec=27/35. Cytokines were analyzed from the first 3 days after infusion, sent before patients developed severe CRS. Logistic and classification tree modeling was used to develop predictors of severe CRS. With a 3 variable regression model, found by forward selection, we accurately predicted which patients developed severe CRS using IFNγ, sgp130, and IL1RA.
Figure 3:
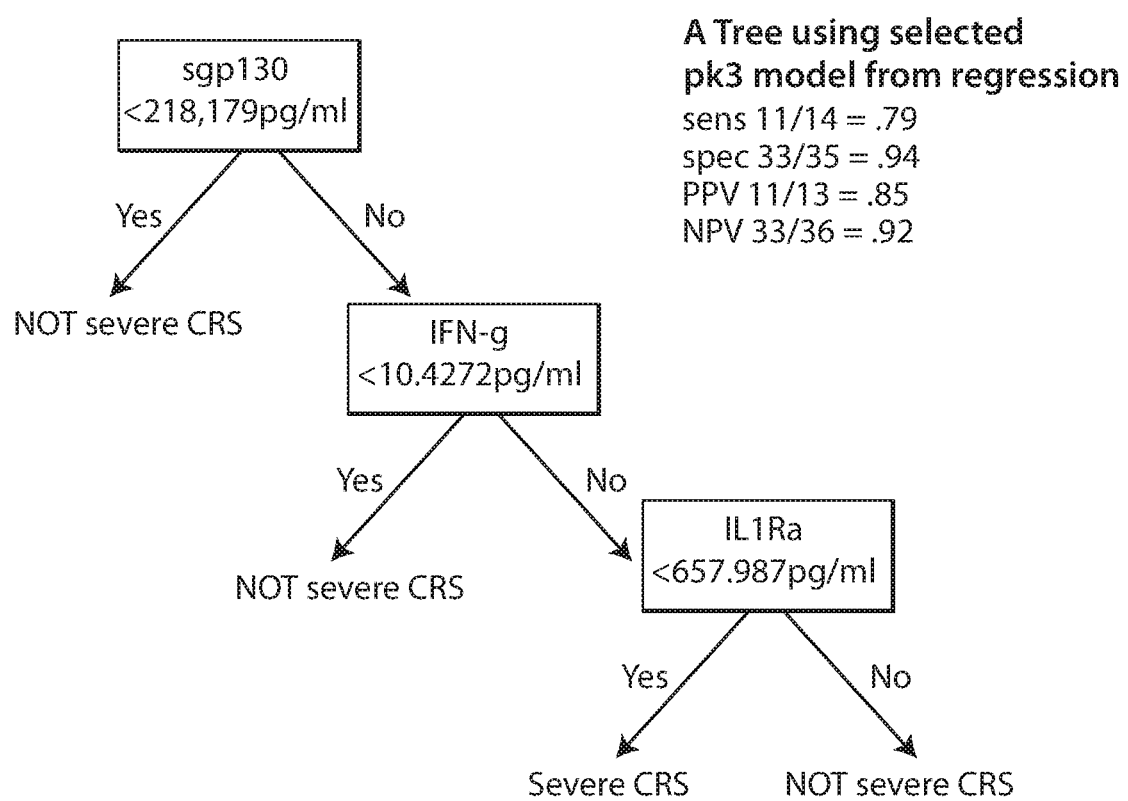
FIG. 3 depicts a decision tree that can be used when evaluating the 3-marker panel of FIG. 2. The sensitivity, specificity, PPV, and NPV of this decision tree are indicated.
Figure 6:
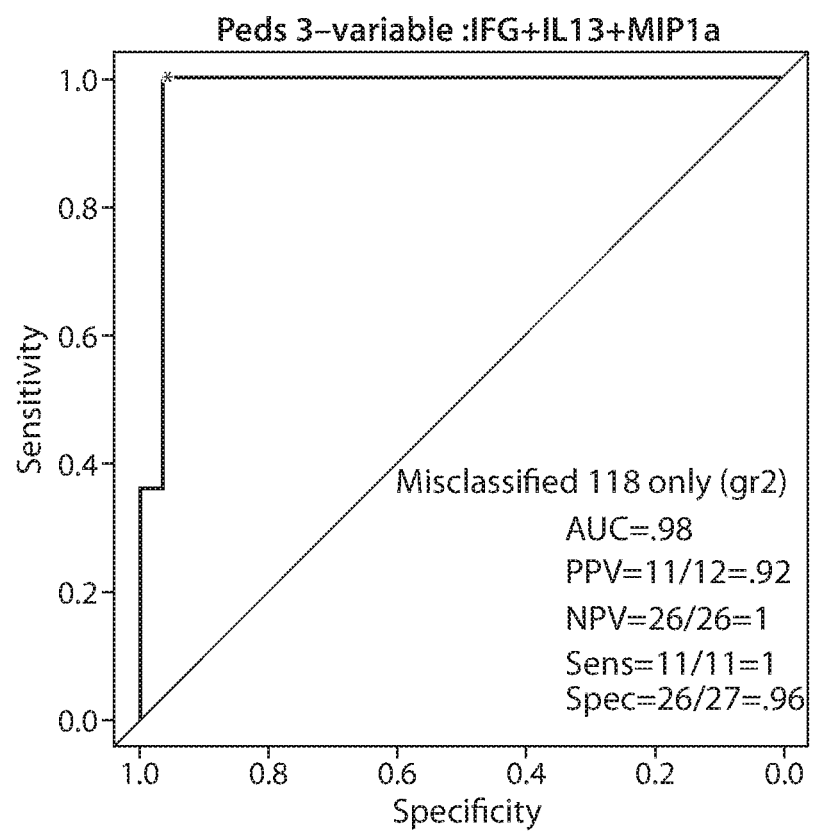
FIG. 6 depicts a ROC curve showing the sensitivity and specificity of a panel of IFN-gamma, IL-13, and MIP1a in pediatric patients. The sensitivity, specificity, PPV, and NPV of this panel are indicated.
Figure 7:
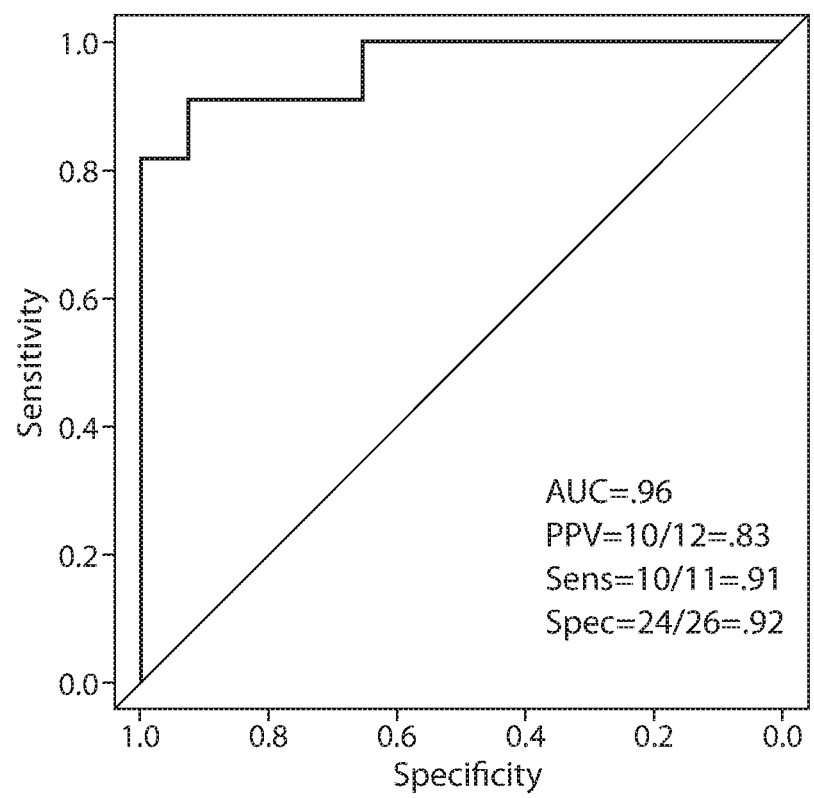
FIG. 7 depicts a ROC curve showing the sensitivity and specificity of a panel of sgp130, IFN-gamma, and disease burden assessment for predicting severe CRS. Sensitivity refers to the true positive rate; specificity refers to the false positive rate. PPV=positive prediction value (precision). Sens=10/11 indicates that there were 11 true positives and the test predicted 10 of them correctly. Spec=24/26 indicates that there were 26 true negatives and the test predicted 24 of them correctly.

Analyzing cytokines from the first 3 days after infusion, sent before patients developed severe CRS, only 2 cytokines, sgp130 and IFN-gamma, were strongly associated with later development of severe CRS (p<0.001) and significant by Holm-Bonferroni (FIG. 1). With a 3 variable regression model, found by forward selection, we accurately predicted which patients developed severe CRS using IFN-gamma, sgp130, and IL1Ra (PPV 75%, NPV 94%, sensitivity 86%, specificity 89%, AUC=0.93) (FIG. 2). For the pediatric cohort, the modeling was even more accurate; a combination of IFN-gamma, IL13, and MIP1α had PPV 92%, NPV 100%, sensitivity 100%, and specificity 96% (AUC=0.98) (FIG. 6). In the pediatric cohort only, a bone marrow aspirate was collected immediately prior to infusion. It was found that disease burden was associated with CRS severity but did not improve the predictive accuracy of the models over the cytokines alone. A combination of sgp130, IFN-gamma and disease burden yielded PPV 77%, NPV 96%, sensitivity 91%, and specificity 88% (AUC 0.95) (FIG. 7). The accuracy of these models was validated in a cohort of 12 additional patients.

The 1-month peak of several clinical laboratory tests were strongly associated with severe CRS, including CRP, ferritin, LDH, AST, and BUN; however, they were not predictive of severe CRS (Table 14). Fibrinogen was also associated with severe CRS. Some of the clinical laboratory tests, including CRP, had a good NPV for early prediction but none had a good PPV.

TABLE 14

Association of clinical laboratory tests with severe CRS.

| | | Total Cohort | |
|---|---|---|---|
| Biomarker | Total Cohort (N = 51) | Grade 0-3 (N = 37) | Grade 4-5 (N = 14) |
| Ferritin (ng/ml) | 23,439 (280-411,936) | 8,290 (280-411,936)**§ | 130,000C (11,200-299,000)**§ |
| LDH‡(U/L) | 1,732 (158-23,778) | 955 (158-19,104)* | 5,594 (1,648-23,778)* |
| CRP‡(mg/dl) | 20.1C (0.7-56.5) | 16.2 (0.7-56.5)*§ | 22.9C (16.0-37.1)*§ |
| ALT (U/L) | 107 (26-1238) | 95 (26-748) | 198 (50-1,238) |
| AST (U/L) | 149 (19-1,427) | 103 (19-1,424)** | 389 (98-1,427)** |
| BUN (mg/dl) | 18 (9-202) | 17 (9-72)** | 44 (12-202)** |
| Cr (mg/dl) | 0.7 (0.2-5) | 0.7 (0.2-4)* | 1 (0.4-5)* |
| Fibrinogen min‡ (mg/dl) <150N (%) | 18/36 (50%) | 7/23 (30%)* | 11/13 (85%)* |
| Fibrinogen min‡ (mg/dl) | 159 (23-624) | 241 (23 ± 624)** | 77 (23-221)** |
| PT (sec) | 17.1 (13.5-45.4) | 15.7 (13.5-28.7)** | 23.1 (17.1-45.4) |
| PTT (sec) | 44.1 (25.7-92.0) | 39.8 (25.7-64.4)* | 54.2 (37.2-92.0)* |

It was hypothesized and demonstrated that children with severe CRS develop clinical and laboratory manifestations similar to macrophage activation syndrome (MAS)/hemophagocytic syndrome (HLH), including hyperferritinemia (>10,000 ng/ml), splenomegaly, and hypofibrinogenemia. Of the tested cytokines, 18 have been previously studied in children with HLH. A near identical pattern of cytokines differentially elevated in HLH was found to be also elevated in patients with CRS4-5 compared with CRS0-3. Cytokines are clustered into three groups (FIGS. 13A and 13B). Those on the left of each panel are cytokines expected to be elevated in HLH. Those in the middle of each panel are those that are elevated in some patients with HLH and normal in others. Those on the right of each panel are cytokines expected to be normal in HLH.

IL6, sIL6R, and sgp130 were markedly elevated in patients with CRS4-5; this IL6 cytokine pattern, along with the pronounced response to tocilizumab, establishes that IL6 trans-signaling is clinically relevant.

These data represent the largest and most comprehensive profiling of the clinical and laboratory manifestations of CAR T cell related CRS and provide novel insights into CRS biology. They represent the first data that can accurately predict which pts treated with CAR T cells have a high probability of becoming critically ill. These data have direct therapeutic relevance and may guide future cytokine directed therapy.

Example 2: Identification of Predictive Biomarkers for Cytokine Release Syndrome after Chimeric Antigen Receptor T Cell Therapy for Acute Lymphoblastic Leukemia Introduction Chimeric antigen receptor (CAR)-modified T cells with anti-CD19 specificity are a highly effective immune therapy for relapsed/refractory acute lymphoblastic leukemia (ALL). Cytokine release syndrome (CRS) is the most significant and life-threatening toxicity. To improve understanding of CRS, cytokines and clinical were measured in 51 CTL019-treated patients. Peak levels of 24 cytokines, including IFNγ, IL6, sgp130, and sIL6R in the first month after infusion were highly associated with severe CRS. Using regression modeling, it could be accurately predicted which patients would develop severe CRS with a signature composed of three cytokines. Results were validated in an independent cohort. Changes in serum biochemical markers, including C-reactive protein and ferritin, were associated with CRS but failed to predict development of severe CRS. These comprehensive profiling data provide novel insights into CRS biology, and importantly represent the first data that can accurately predict which patients have a high probability of becoming critically ill.

Chimeric antigen receptor (CAR)-modified T cells with specificity against CD19 have demonstrated considerable promise against highly refractory hematologic malignancies. Dramatic clinical responses with complete remission rates as high as 90% have been reported in children and adults with relapsed/refractory acute lymphoblastic leukemia (ALL). Patients have been treated with CTL019, engineered T cells composed of an anti-CD19 single chain variable fragment (scFv), CD3ζ activation domain, and 4-1BB costimulatory domain. Marked in vivo CAR T-cell proliferation (100 to 100,000×) leads to efficacy, but can lead to toxicity, including cytokine release syndrome (CRS). CRS is the most common potentially severe toxicity associated with CAR T cells. CRS is not unique to CAR T cells and occurs with other therapies that engage T cells to kill cancer cells, including bi-specific T-cell engaging (BiTE™) antibodies such as blinatumomab.

Despite the frequency of CRS post-infusion of CAR T cells, relatively little is known about the underlying biology of the syndrome. Improved understanding of CRS may lead to better recognition, improved treatment, and perhaps the ability to prevent or abrogate the most serious complications of CRS. The ability to predict which patients will become ill with severe CRS is important to the development of CAR T cell therapy, yet there are no published accurate predictors for severe CRS. CRS can be successfully ameliorated with the IL6R inhibitor, tocilizumab, and it is also used after T-cell engaging therapies. Despite its efficacy, the mechanism of tocilizumab in alleviating CRS remains poorly defined. Currently, tocilizumab is used to treat CRS after symptoms become severe. It is unknown whether tocilizumab can prevent CRS or, if used too early, could decrease the efficacy of the CAR T cells.

To better characterize and potentially predict CRS, this Example describes the evaluation of data from 39 children and 12 adults with refractory/relapsed ALL treated with CTL019. Clinical and comprehensive biomarker data were obtained, measuring 43 different cytokines, chemokines, and soluble receptors (hereafter collectively called 'cytokines') as well as a number of other laboratory markers. Serial measurements from these patients allowed a number of novel observations that improve understanding of the biology of CRS and will directly affect clinical practice.

Results to be discussed herein include: (1) a prediction model for severe CRS; (2) an overall description of the timing and pattern of cytokine rise and fall after treatment with CAR T cells; (3) a comprehensive comparison of cytokine profiles between patients who develop severe CRS versus not, which reveals significant details of the underlying biology of severe CRS; (4) analysis showing that patients who develop severe CRS develop clinical, laboratory, and cytokine profiles that mirror hematophagocytic lymphohistiocytosis (HLH)/macrophage activation syndrome (MAS); and, (5) a characterization of the effects of tocilizumab on CRS, establishing the toxicity of CRS is mediated by trans-IL6 signaling that is rapidly abrogated after tocilizumab treatment in the majority of patients.

Methods

Clinical and laboratory data were collected on 39 patients with ALL treated consecutively with CTL019 on a phase 1/2a clinical trial (NCT01626495). Clinical and laboratory data were collected on 12 adults treated with CTL019 on two trials (NCT02030847 and NCT01029366). Written informed consent was obtained from all subjects or their legal guardian according to the Declaration of Helsinki and all protocols were approved by institutional review boards (IRBs). A limited set of clinical and laboratory data was also collected on an additional 12 consecutive patients treated with CTL019 on NCT01626495. This data set provided a validation cohort for the predictive models. CRS was graded as previously described and as defined in Supplemental Table 1A and 1B of Teachey et al. Cancer Discovery, which is herein incorporated by reference in its entirety. This grading scale was developed a priori and before any data analysis. Cytokine markers were measured on serum samples from 10 healthy volunteers (see Example 3 for details).

All data were decoded and maintained in secure databases. 43 unique cytokines and a panel of clinical laboratory tests, including chemistries, ferritin and C-reactive protein (CRP) were serially monitored. CTL019 cells were serially measured in peripheral blood by quantitative PCR. Analysis was restricted to the first month after infusion of CTL019. Baseline bone marrow aspirate and biopsies were collected in the pediatric cohort. MRD was performed in the CLIA and CAP approved Children's Oncology Group Western Flow Cytometry Reference Laboratory at the University of Washington (Seattle, Wash.).

Statistical Methods

Clinical, laboratory, and cytokine markers associated with CRS are summarized overall and by occurrence of severe CRS (grade 4-5) for the pediatric, adult, and combined cohorts. For markers measured serially, values were summarized both as the peak over the first 3 days and over the month post-infusion in order to capture early and overall peak values of these biomarkers during the period when patients experienced CRS. In addition, relative changes from baseline (fold-changes) were evaluated during the first 3 days after infusion. The month was defined as the first 35 days, allowing for a 1-week window beyond the expected 28-day evaluation. Between-group comparisons were performed using Fisher's exact test for discrete and exact Wilcoxon rank-sum test for continuous factors. Fibrinogen and CRP, due to a few values recorded as exceeding a limit of detection that was within range of other observed values, were analyzed with the generalized Wilcoxon test for right-censored data. Values less than the lower limit of detection were recorded as half the lower limit. All statistical tests were two-sided and generally done at the 0.05 level. Consideration for multiple comparisons was given when examining hypotheses for the 43 cytokine biomarkers, as described below. Statistical analyses were performed using R (version 3.2.1; R Development Core Team, Vienna, Austria) and SAS (version 9.4; SAS Institute Inc, Cary, N.C.) software.

Cytokine Analysis

Several hypotheses regarding cytokine levels were investigated, and statistical associations were declared significant only if they remained significant at the 0.05 level, after the Holm's adjustment for the 43 multiple comparisons. All hypotheses that were tested were developed a priori. Comparisons of cytokine levels analyzed in this manner included: 1-month peak and 3-day peak between those with versus without severe CRS, patient baseline between those with high versus low disease burden and baseline patient versus healthy adult subjects; 1-month and 3-day peak analyses were performed for the combined, adult and pediatric cohorts separately. Multiple published studies have demonstrated that while cytokines can vary between children and adults with disease or after antigen stimulation, baseline values in normal healthy children and adults are similar. Thus, a separate healthy pediatric cohort was not included. In order to rule out that any variation around the sampling frequency of cytokine levels between patients could be biasing these comparisons, 1-month analyses were repeated including measurements from a reduced, common sampling schedule that was shared by nearly all subjects. It was hypothesized that patients treated with T-cell engaging therapies, including CTL019, who experience severe CRS, develop abnormal macrophage activation with secondary hemophagocytic lymphohistiocytosis (HLH). This hypothesis was made based on clinical symptomatology and marked hyperferritinemia. Numerous studies have shown ferritin>10,000 ng/ml is highly sensitive and specific for HLH in children. To establish whether the patients with severe CRS were manifesting HLH, the cytokine profiles from patients who developed severe CRS were compared with published reports of cytokine profiles in patients with primary HLH associated with a genetic predisposition. Of the 43 tested cytokines, 19 have been previously studied in children with HLH. This subset of cytokines was reconsidered for the association with severe CRS to compare the HLH pattern, with Holm's adjustment for 19 multiple comparisons.

In order to understand which factors may be most intrinsically involved with CRS syndrome and the immune system's initial response, a prediction model was developed for severe CRS that considered clinical and laboratory factors measured within the first 3 days post-infusion. Models and 10% overall: ALT, AST, BUN, CR, Ferritin, qPCR, LDH, the 43 cytokines markers, as well were kept small due to the limited number of severe CRS cases (14 overall and 11 in the pediatric cohort). Candidate variables included those factors for which the 3-day peak was missing in no more than 2/14 cases CRS-defining symptoms in the first 2 days post-infusion (yes/no) and age at infusion. 3-day peak fold change was also considered for the 43 cytokines and baseline disease burden was an additional candidate variable for the pediatric cohort. Two patients (both in pediatric cohort) developed severe CRS on Day 3; however, all data included in the models was collected at least 12 hours prior to the development of severe CRS. Logistic regression and classification tree models were fit in the combined and pediatric cohorts, hereafter referred to as the discovery cohort. The adult cohort was too small to model separately. For the logistic regression models, forward selection using the Akaike information criterion (AIC) was used to select the final models. The deviance statistic was used to select the tree models. Models were validated in an independent cohort of 12 pediatric patients, referred to as the validation cohort.

Results

Clinical Description of Patients

A total of 51 patients with ALL, 39 patients in the pediatric cohort, age 5-23, and 12 in the adult cohort, age 25-72, were treated. The two cohorts were defined based on the clinical trials and treating institutions. 47 patients (37 pediatric; 10 adults) had B ALL in first to fourth relapse, 1 child had relapsed T-ALL with aberrant CD19 expression, and 3 patients (1 pediatric; 2 adults) had primary refractory B-ALL. 31 patients (27 pediatric; 4 adults) (61%) had relapsed after prior allogeneic hematopoietic stem cell transplant (SCT). 4 patients (all pediatric) had previously been treated with blinatumomab, a CD19 BITE antibody. No patient was treated with any other CD19-directed therapy prior to CTL019. Data on response to CTL019 in the first 30 patients (25 children and 5 adults) were recently published, demonstrating a 90% complete remission (CR) rate and 6 month event free survival (EFS) of 67%.

Clinical Description of Cytokine Release Syndrome (CRS)

48 of 51 patients (94%) developed CRS; the three that did not were children. Patients with CRS typically presented with flu-like illness. The majority of patients developed mild (grade 1-2) (18/51; 35%) to moderate (grade 3) CRS (16/51; 31%), and 14 patients (27%) developed severe (grade 4-5) CRS (12 grade 4 and 2 grade 5) (see Table 1 of Teachey et al., Cancer Discov. 2016 June; 6(6):664-79, which article is herein incorporated by reference in its entirety, including the supplemental materials). For patients who developed fever, start of CRS was defined as the day with the first fever>=38.0° C. (100.5° F.) relative to infusion of CTL019. Stop of CRS was defined as 24 hours without fever or vasoactive medications, indicating recovery from shock. Four patients developed CRS without fever: start and stop of CRS were defined based on the first day with flu-like symptoms and the first 24-hour period without symptoms, respectively.

Nine patients required mechanical ventilation and twenty patients required vasoactive medications for either distributive (19/20) or cardiogenic shock (1/20). Fourteen patients required high dose vasoactives. Only 6 patients developed a documented co-morbid infection and only 2 of these infections, both in adults, were clinically consistent with sepsis. Clinical factors related to CRS are summarized in Table 1 of Teachey et al. Three adults died in the first 30 days after CTL019 treatment. Some children with severe CRS developed organomegaly, including hepato- and splenomegaly and a number of patients developed encephalopathy.

Laboratory Description of CRS

Laboratory markers of inflammation and organ failure were serially evaluated in patients treated with CTL019. Baseline ferritins (N=48) were elevated in the majority of patients (median: 1580 mg/dl, range 232-14,673) as a consequence of systemic inflammation and/or iron overload. Only six children out of the 37 measured and no adults had baseline ferritins<500 mg/dl. Peak ferritins (defined as highest value in first month after CTL109 infusion) were very high in all patients regardless of grade but the median was significantly higher in patients with grade 4-5 CRS ($p<0.001$): grade 0-3 CRS (median 8,290 mg/dl, range 280—411,936) and grade 4-5 CRS (median 130,000 mg/dl, range 11,200—299,000). Similar trends were seen in adults and children. All patients with grade 4-5 CRS had a peak ferritin>10,000 mg/dl, a value that is considered sensitive and specific for macrophage activation/HLH syndrome in children. Thirty patients, including 20 of 39 (51%) children and 10 of 12 (83%) adults with grade 0-3 CRS had a peak ferritin>10,000 mg/dl.

Baseline CRP was elevated in a majority of patients (median 1.20 mg/dl, range 0.12-29.4). Three children and 2 adults did not have CRP tested at baseline. 24 of 36 children (67%) and 1 of 10 adults had a baseline CRP>1 mg/dl. Similar to ferritin, 1-month peak CRP was very high in the majority of patients with grade 4-5 CRS (median 22.9, range 16.0-37.1) and grade 0-3 CRS (median 16.2, range 0.7-56.5), with a statistically significant median difference in grade 4-5 versus grade 0-3 CRS ($p=0.010$). Similar trends were seen in adults and children. Consistent with generalizable inflammation and hypotension, ALT, AST, BUN, LDH and Cr markedly increased in the majority of patients with CRS with a statistically significant increase in grade 4-5 versus 0-3 CRS. While peak values of these clinical labs correlated with severity of CRS, none of these labs were helpful at predicting CRS in the first 3 days. Early CRP elevation was associated with grade 4-5 CRS ($p=0.02$), but, contrary to another published report, early assessment of CRP in the first three days following CTL019 infusion was not found useful in predicting severity of CRS (AUC=0.73). For example, considering CRP as a screen for high-risk cases, a CRP>6.8 mg/dl would have identified only 72% of the cases and had a positive predictive value (PPV) of 43%. Similarly, early ferritin elevation was associated with grade 4-5 CRS, but it was not useful in predicting CRS.

Fibrinogen<150 mg/dl is used in the diagnostic criteria for HLH as it is a sensitive marker of the syndrome. A strong association was found with low fibrinogen and grade 4 CRS in the pediatric cohort but not adults. Children became mildly coagulopathic with more significant coagulopathy with severe CRS. Adults also developed hypofibrinogenemia and mild coagulopathy; however, this was seen across CRS grades. While bleeding was rare, understanding the coagulopathy has direct clinical implications as many of the patients required cryoprecipitate in addition to fresh frozen plasma to maintain hemostasis.

Cytokine Profiles

In order to understand the biology of CRS after CAR T cell therapy, serial cytokine assessment was performed on the 51 patients. Median baseline values from 50 patients with ALL (one subject did not have a baseline value) were compared with a 10-patient normal donor cohort. Of note, it was found that a number of cytokines, including sIL2Ra and MCP1, were consistently elevated in most patients with ALL compared to the normal donors and significant by Holm's adjusted p-value. It was determined if certain cytokines were associated with baseline disease burden in children (bone marrows were not collected at the time of infusion in many adults). Only EGF, IL12 and IL13 were associated with higher disease burden at baseline by Holm's p-value.

Cytokine profiles in patients who had severe CRS were compared with patients who did not. It was found that peak levels of 24 cytokines, including IFNγ, IL6, IL8, sIL2Rα, sgp130, sIL6R, MCP1, MIP1α, MIP1β, and GM-CSF sent in the first month after CTL019 were associated with grade 4-5 CRS compared to grade 0-3 CRS and significant by the Holm's-adjusted p-value (FIGS. 11A, 11B, 11C, 11D, 12A, 12B, 12C, and 12D). As a sensitivity analysis, this analysis was repeated with a reduced set of cytokine measures, keeping only one measure per target assessment window specified in the protocol, to equalize the number of measurements between subjects. Results were similar; 23 cytokines were significant—all amongst the previously found 24. Only IL1RA, the weakest significant result of the original 24, did not remain significant.

Certain cytokines peaked earlier than others in patients with severe CRS. Understanding the timing of the rise and fall improves understanding of not only the underlying biology but also has potential therapeutic relevance. IFNγ and sgp130, for example, rise very early. These two cytokines were the only ones differently elevated for severe versus non-severe CRS in the first 3 days after infusion and prior to patients becoming critically ill after adjustment for multiple comparisons (Holm's). In contrast, while IL6 is the cytokine most strongly associated with severe CRS over the first month early IL6 levels (days 0-3) were not different by CRS after adjustment for multiple comparisons.

It was found that severity of CRS was weakly associated with the peak CAR T cell expansion by copies/microgram qPCR over one month ($p=0.058$); however the peak in the first 3 days post infusion was not associated with CRS severity.

Figure 4:
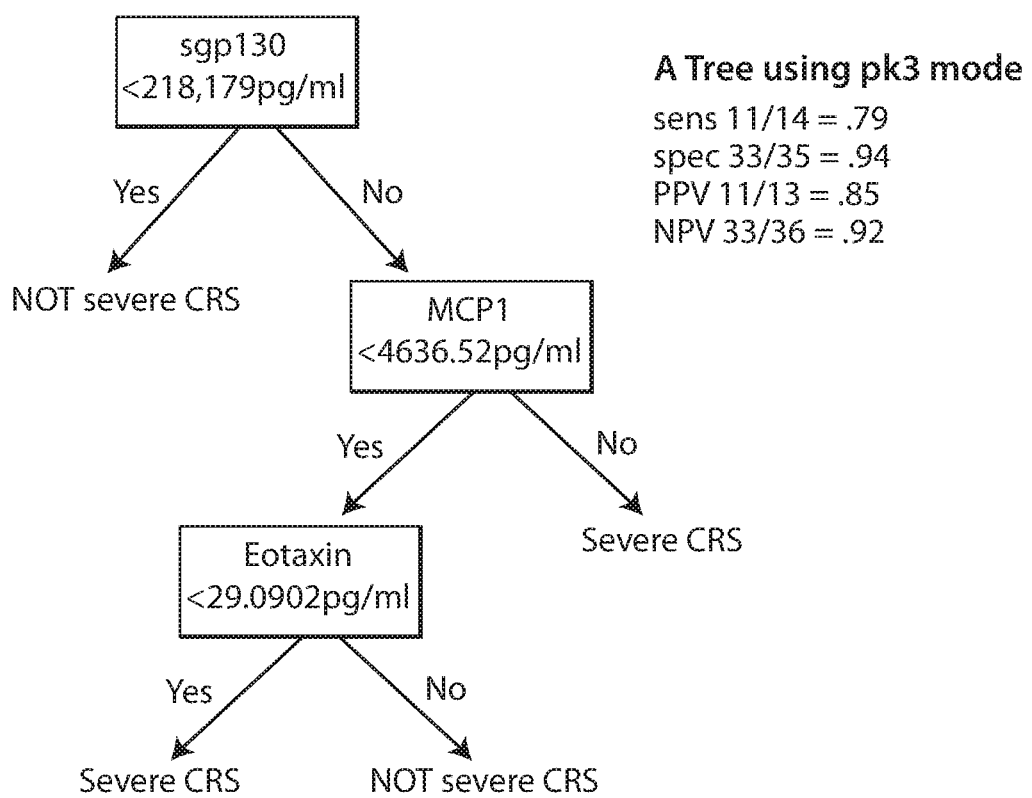
FIG. 4 depicts a decision tree that can be used when evaluating a 3-marker panel comprising sgp130, MCP1, and eotaxin, based on analysis of the combined cohort. The sensitivity, specificity, PPV, and NPV of this decision tree are indicated.
Figure 5:
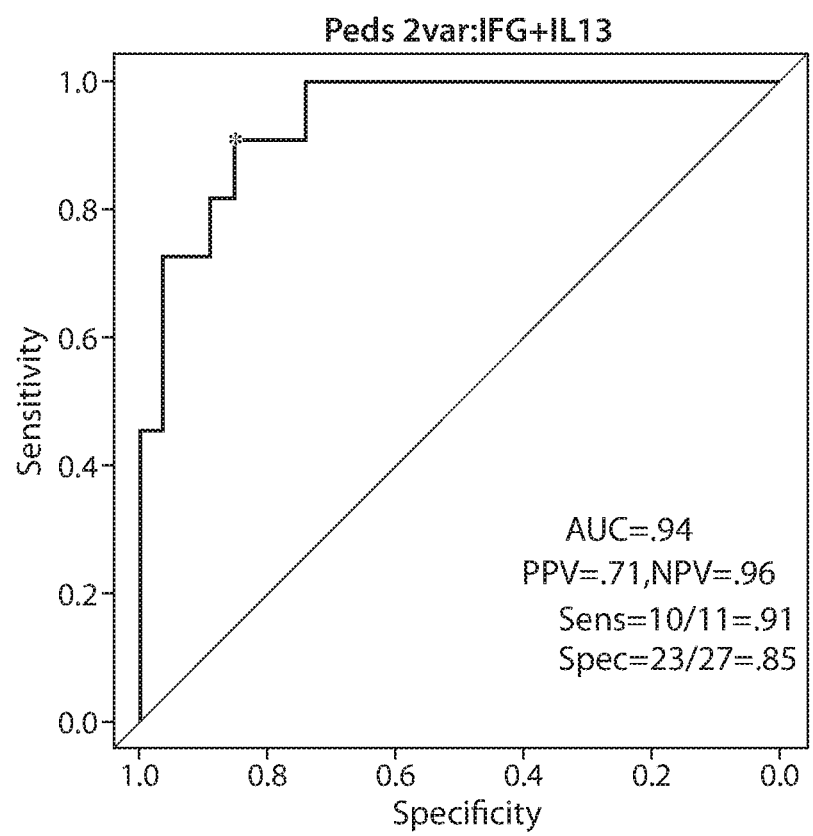
FIG. 5 depicts a ROC curve showing the sensitivity and specificity of a panel of IFN-gamma and IL-13 in pediatric patients. The sensitivity, specificity, PPV, and NPV of this panel are indicated.
Figure 9:
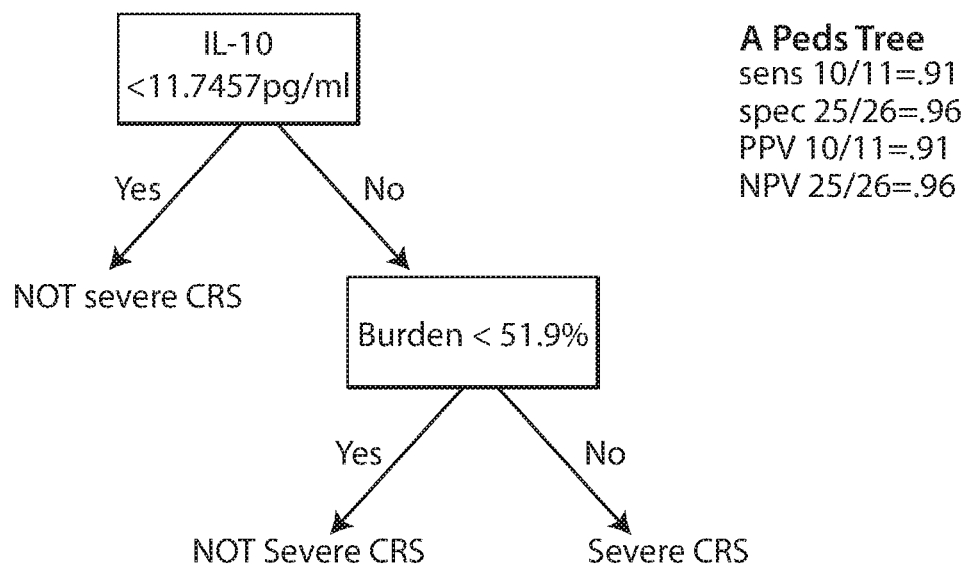
FIG. 9 depicts a decision tree that can be used when evaluating a panel comprising IL-10 and tumor burden, e.g., in pediatric patients. The sensitivity, specificity, PPV, and NPV of this decision tree are indicated. A combination of a single cytokine, IL10 and disease burden using decision tree modeling was very accurate for CRS prediction. In some embodiments, the threshold for disease burden is <51.9%, as shown, and in other embodiments, the threshold for disease burden is <50%.

Predictive Modeling 16 predictive models were developed and analyzed (8 from combined cohort and 8 from pediatric only cohort) fit based on data from the main (discovery) cohort of 51 patients. Table 3 of Teachey et al. lists the best overall regression models and decision tree models for both the combined and pediatric only cohorts. The forward-selected logistic regression model accurately predicted which patients developed grade 4-5 CRS using IFNγ, sgp130, and sIL1RA with sensitivity 86% (95% CI: 57, 98), specificity 89% (95% CI: 73, 97), and AUC=0.93 (95% CI: 0.86, 1.0) (FIG. 2). Using a decision tree, a combination of sgp130, MCP1, and Eotaxin had sensitivity 86% (95% CI: 57, 98) and specificity 97% (95% CI: 85, 100). See FIG. 4. For the pediatric cohort, the modeling was even more accurate; the forward-selected logistic regression model including IFNγ, IL13, and MIP1α had sensitivity 100% (95% CI: 72, 100), specificity 96% (95% CI: 81, 100) (AUC=0.98; 95% CI: 0.93, 1.0) See FIG. 6. Disease burden prior to infusion can predict severe CRS. In the pediatric cohort only, a bone marrow aspirate was collected immediately prior to infusion. We found disease burden did not improve the predictive accuracy of the models over the cytokines alone using regression modeling; however, it was identified as an important predictive variable in the pediatric cohort using the decision tree modeling. A combination of IL10 and disease burden had sensitivity 91% (95% CI: 59, 100), and specificity 96% (95% CI: 81,100) (FIG. 9). As many trials are not measuring disease burden, it is noted that a classifier build on predictors from the top candidate logistic model included a combination of IFNγ and MIP1α and had sensitivity 82% (95% CI: 48, 98) and specificity 93% (95% CI: 76, 99). See FIG. 8.

The accuracy of the models was then tested using the validation cohort of 12 additional pediatric patients. It was found that all of the models performed extremely well in the validation cohort. Thus, the validation cohort did not change the model rank order.

Hemophagocytic Syndrome/Macrophage Activation Syndrome as a Consequence of CTL019

19 cytokines studied in our patients have been studied in children with HLH. A nearly identical pattern was found of those cytokines having 1-month peak values differentially elevated in HLH patients also elevated in patients with versus without severe CRS (FIGS. 13A and 13B). There were statistically significant differences in IFNγ, IL10, sIL2Rα, IL6, IL8, IP10, MCP1, MIG and MIP1β in CRS grade 4-5 vs CRS grades 0-3. All of these cytokines are expected to be elevated in patients with HLH. No significant differences by Holm's adjusted p-value were seen in IL1β, IL2, IL5, IL7, IL12, IL13, and IL17, cytokines expected to be normal in HLH based on published work. GM-CSF and TNFα were differentially elevated in our study in those with severe CRS. GM-CSF and TNFα have been demonstrated to be elevated with HLH in some studies while normal in others. IL4 is typically normal in patients with HLH. It was differentially elevated in this study in the patients with severe CRS, although the levels were low in both groups.

IL6 Signaling and IL6 Directed Therapy 21 patients were treated with tocilizumab for CRS. 7 of 15 subjects with grade 3 CRS and all 14 subjects with grade 4-5 CRS received tocilizumab. 10 of the 21 subjects (4 pediatric; 6 adults) received more than one dose. 12 patients were also treated with corticosteroids and 2 patients received etanercept. No patient received siltuximab. Tocilizumab was given a median of 5 days after infusion with CTL019 (range 2 to 12 days). Supplemental Table 15 of Teachey et al. details the time to initiation of tocilizumab relative to infusion, first fever, use of vasoactives, and intubation, if applicable. Response to tocilizumab was rapid. Many patients became afebrile immediately after the first dose. Most patients were able to wean vasoactives over the 24-36 hours after receiving tocilizumab and they were stopped a median of 4.5 days after tocilizumab was given. While all of the children with CRS survived and responded to tocilizumab, 3 adults treated with CTL019 died.

FIG. 14 depicts the levels of 4 cytokines (IFNγ, IL6, sIL6R, and sgp130) over time in the 14 grade 4-5 subjects treated with tocilizumab. After first dose of tocilizumab, there was generally a transient rise in IL6 levels, followed by a rapid decrease. sIL6R generally increased and continued to remain elevated for at least 2-3 weeks after tocilizumab, and sgp130 appeared to increase in some patients but not in others after tocilizumab.

Discussion

This Example describes a number of observations. First, models were developed that can predict which patients treated with CAR T cells are likely to become critically ill before they become ill, potentially allowing early interventions that could reduce morbidity or mortality. Second, it establishes that concentrations of sIL6R and sgp130 are likely clinically and biologically relevant, as this is the first work that has systemically evaluated sIL6R and sgp130 after CAR T cells. Third, 24 distinct cytokines were identified that are differentially expressed in patients with versus without severe CRS, adding new insight into the biology underlying severe CRS. Finally, it confirms that patients who develop severe CRS develop a clinical, laboratory, and biomarker profile consistent with secondary HLH.

The most common and potentially severe toxicity seen across trials using CAR-modified T cell therapy is CRS. Data suggests a correlation between development of CRS and response to CAR T cells. Nevertheless, there does not appear to be a strong association between the degree of CRS and outcome. Similar to data with other T-cell engaging therapies, including blinatumomab, it has been found that the severity of CRS may be associated with disease burden at the time of treatment. While this association exists, as we have demonstrated herein, disease burden alone is not sufficient to predict which patients will develop severe CRS. The PPV of high disease burden alone was poor as only 10 of 23 patients with an M3 marrow (>25% blasts) developed severe CRS. However, low disease burden does have a strong negative predictive value (NPV). In our pediatric cohort, only one of 15 patients who had a marrow which demonstrated<5% blasts at time of CTL019 infusion developed severe CRS. Baseline disease burden was not obtained in most adults and our pediatric trials moving forward are no longer assessing disease burden at the time of infusion. These data demonstrate that the risk of CRS can be predicted accurately without the need for assessment of disease burden at the time of infusion.

Severe CRS is a potentially life-threatening toxicity. Indeed, 2 adults in this series died as a consequence of CRS. The ability to predict which patients may develop severe CRS prior to its development may be helpful in mitigating toxicity, as cytokine-directed therapy could be instituted before a patient becomes critically ill. Patients predicted to develop severe CRS could be more closely monitored to allow early initiation of aggressive supportive care. In contrast, the ability to predict which patients are unlikely to develop severe CRS can prevent unnecessary early hospitalization and/or exposure to unneeded cytokine-directed therapy. Accordingly, the models we have developed using a small number of cytokines to predict severity of CRS with both high sensitivity and specificity have direct clinical and therapeutic relevance. It is not known if early intervention or prevention of CRS will limit efficacy. Prospective trials initiating early intervention based on cytokine profile models will need to be carried out carefully.

No standard clinical laboratory tests were found to be helpful in predicting CRS severity, as many (ferritin, CRP, LDH, AST, ALT, BUN, and CR) peaked after patients became ill. Unlike prior reports by another group, this work did not show that early assessment of CRP could accurately predict severity of CRS. While not wishing to be bound by theory, in some embodiments, the early predictive cytokine profiles identified here are also relevant to other T-cell engaging therapies such as BiTEs, as well as after cytotoxic T lymphocytes targeted at viruses.

In addition to developing accurate predictive models, this study contributes a number of key insights into the biologic understanding of CRS. Analyzing cytokines sent before patients developed severe CRS, it was demonstrated that sgp130 and IFNγ were strongly associated with later development of severe CRS. The earlier observation that IFNγ, IL6, and sIL2Ra show a marked differential increase in patients with severe CRS as compared with patients without severe CRS was confirmed. Marked differences were found in a number of additional cytokines not previously studied after CAR T cell therapy. Generally, cytokines that were differentially elevated based on CRS grade included either cytokines released from activated T cells (sIL2Rα, IFNγ, IL6, sIL6R, GM-CSF) or activated monocytes/macrophages (IL1RA, IL10, IL6, IP10, MIG, INFα, MIP1α, MIP1β, sIL6R), as well as chemokines that are chemotactic for monocytes/macrophages (MCP1, MIP1β), and cytokines that are often elevated after tissue damage and inflammation (IL8, GCSF, GMCSF, VEGF, IL6, sRAGE).

It was found that patients who develop severe CRS develop a clinical phenotype that resembles MAS/HLH, as well as laboratory evidence of abnormal macrophage activation, including elevated ferritin, low fibrinogen, and a cytokine profile that mirrors that seen in genetic forms of HLH. An IFNγ level of 75 pg/ml and an IL10 level>60 pg/ml has 98.9% specificity and 93% sensitivity for HLH when measuring cytokine levels in critically ill children (with and without malignancies) with either sepsis or HLH. IFNγ is not expected to be elevated in patients with sepsis. All patients with CRS 4-5 in this series had an IFNγ>75 pg/ml and IL10>60 pg/ml. IL4 is the only cytokine tested that was an outlier from the a priori hypothesis; however, the absolute values were very small in all patients. Thus, it is hypothesized that IL4 is likely not clinically or biologically relevant in this cohort. Future work will determine if there is any genotype-phenotype association between the development of MAS/HLH after CAR T cells and mutations in genes that predispose to the development of HLH, including PRF1.

IL6-directed therapy is the cornerstone of cytokine-based therapy after treatment with CAR T cells. It has been shown to be effective and, importantly, does not appear to decrease efficacy of the CAR T cells. That said, as IL6 does not appreciably rise prior to the development of CRS, clinical assessment of IL6 in the first few days after infusion will not help determine which patients will develop severe CRS or require IL6 directed therapy. It is unknown whether early treatment with tocilizumab prior to development of CRS would be of benefit. Tocilizumab has a very long half-life (11-14 days). Thus, if given early, drug would be present at the time of IL6 peak and could in theory prevent severe CRS.

This study demonstrates the importance of trans-IL6 signaling in CRS. IL6 signals through two mechanisms, either via the membrane-bound or soluble IL6 receptor (sIL6R). In classical IL6 signaling, IL6 binds to its membrane-bound receptor. Most cells do not express IL6R and are not responsive to classical IL6 signaling. In trans-IL6 signaling, sIL6R binds IL6 and the complex associates with membrane-bound gp130. Membrane-bound gp130 is associated with JAK1, JAK2, and TYK2. Accordingly, IL6-trans signaling activates the Jak/Stat pathway. IL6-trans signaling occurs in cells that do NOT express the IL6R. Normally, high levels of soluble gp130 (sgp130) and sIL6R in the blood serve as a buffer, blocking IL6-trans signaling. In healthy persons, IL6 levels are typically on the order of pg/ml, yet sIL6R and sgp130 levels are typically 1000× higher at ng/ml levels. Consequently, IL6-trans signaling only occurs when IL6 levels rise from pg/ml to ng/ml levels. IL6-trans signaling can be blocked either by lowering IL6 levels, blocking the interaction of IL6 with IL6R, raising sIL6R levels, raising sgp130 levels, or blocking the interaction of IL6-IL6R with sgp130. Tocilizumab is an anti-IL6R monoclonal antibody. In other IL6-mediated diseases, IL6 levels often go up and sIL6R levels either increase or decrease after treatment as the interaction between IL6R and IL6 is blocked. After treatment with tocilizumab, there appeared to be a transient rise in IL6 followed by a rapid decrease in the CRS cohort. sIL6R levels also appeared to increase significantly after tocilizumab, because the complex of sIL6R and tocilizumab cannot be cleared by the kidney due to its size. These data suggest tocilizumab is blocking IL6-trans signaling through multiple mechanisms: blocking the interaction of IL6R with IL6, raising sIL6R to increase the IL6 buffer, and eventually lowering IL6 levels. Of note, collection of samples was not uniform between patients before and after treatment with tocilizumab, as tocilizumab was given on different days relative to time of infusion and some patients received more than one dose. Uno and colleagues recently published data that suggest that patients with rheumatoid arthritis who have elevated sgp130 levels are more likely to respond to tocilizumab as higher sgp130 levels will neutralize more IL-6/sIL-6R complexes, leaving less complexes that need to be neutralized by tocilizumab. Thus, it is believed that the high levels of sgp130 that are seen prior to treatment with tocilizumab are clinically and biologically relevant; however, future work investigating the importance and function of trans-IL6 signaling is needed.

Other agents that target IL6 signaling are either commercially available or in clinical development, including direct IL6 inhibitors such as siltuximab and the IL6 trans-signaling blocker sgp130Fc. These agents have the potential to be effective for CRS, but future studies are needed. Our extensive cytokine profiling does not support the use of TNFα blockade after CAR T cells. While some of the soluble TNF-receptors were markedly elevated in patients with severe CRS, peak levels of TNFα were quite low. Interestingly, it has recently been shown that induction of shedding of TNF-receptors leads to complete unresponsiveness of TNFα target cells. Published studies demonstrating efficacy of TNFα blockade used inhibitors in diseases with elevated serum or tissue TNFα levels. While some TNFα blocking agents such as etanercept also target TNF-receptors, it is unknown whether targeting TNF-receptors in patients with low levels of TNFα is efficacious. For patients who become critically ill after CAR T cells and do not respond to IL6 blockade, Jak/Stat, IFNγ, or sIL2Ra inhibitors could potentially be effective in ameliorating CRS symptoms. Unfortunately, these would likely affect the function of the CAR T cells.

Confounding variables that can affect cytokine production should always be considered when interpreting cytokine patterns to understand disease biology or develop predictive models. Mild differences in baseline cytokine values can occur in healthy normal subjects based on age, gender, and ethnic background. Disease-related factors, including the type of malignancy or disease burden can also affect cytokine production. It is also important to evaluate both relative and absolute changes in cytokine production. Differences between populations are sometimes reported as fold-changes without consideration of the absolute values, but this can be misleading, as statistically significant differences may not be biologically or clinically meaningful. Values were considered in the context of the degree of variation seen in healthy populations and the levels reported in patients with inflammatory diseases and/or infection. Both the absolute and relative differences between groups were considered.

Despite several important observations, this study has several limitations. While it describes CRS after CAR T cells in the largest cohort of patients to date, the total number of patients with grade 4-5 CRS was relatively small. Nevertheless, the findings had adjustments for multiple comparisons and the prediction models remained accurate in an independent validation cohort. The data reflect patients treated at two centers with CAR T cell products generated using the same manufacturing process, and it is unknown if the models will be generalizable. The only laboratory biomarkers that were robust for CRS prediction were cytokines and testing for cytokines is not available with rapid turnaround in many clinical laboratories. The data allow the design of a focused panel of analytes that can be used to predict and track CRS. Common Terminology Criteria for Adverse Events (CTCAE) grading scales do not adequately or accurately define CRS after T-cell engaging therapies. Thus, different sites and different publications use different grading scales, which can make comparisons between studies challenging. Lee and colleagues and Davila and colleagues also published CRS grading scales for patients treated with CAR T cells (see Supplemental Tables 16 and 17 of Teachey et al.). A comparison of the CRS grading scale to other published grading scales is described in the Supplemental Discussion of Teachey et al. The grading systems are similar enough that the predictive models are relevant in the other grading systems. Regardless of "numerical grade" the models herein identify patients who develop life-threatening complications of CRS (mechanical ventilation and/or decompensated shock).

The need for predictive models is to distinguish patients who become critically ill from CRS with those who do not. The demarcation was based on patients who developed life-threatening complications of CRS, including decompensated shock or respiratory failure (grade 4-5). Patients with grade 0-2 CRS developed only mild illness. Grade 3 CRS in contrast represents a heterogeneous clinical spectrum, as some patients only required IV fluids or minimal supplemental oxygen, whereas others required lowdose vasoactive medications or developed more significant hypoxemia. Moving forward with certain trials, it may be important to loosen our definition of "severe CRS" and include patients who became very ill but did not develop life-threatening CRS. Additional analyses was performed sub-dividing patients with grade 3 CRS based on the need for any vasoactive medications or significant oxygen requirement (>=40% FI02) into two groups (3a and 3b) and re-split the cohort into severe and not severe defined as CRS 0-3a vs CRS 3b-5. Logistic regression and decision tree modeling to develop new models with this alternate categorization and also tested the accuracy of the "original" models using the alternate categorization. These additional models and the additional analyses are included in the Supplemental Results and as Supplemental Tables 18 and 19 and Supplemental FIGS. 5a-e of Teachey et al.

The biology of CRS was studied, and it was investigated if certain cytokines measured early could predict CRS severity. Additional variables not studied herein may predict severe CRS and these will be investigated in future work. These include T cell phenotype of the product, T cell function of the product, CD19 polymorphisms that may differentially activate CTL019, tumor expression of CD19 or PD-L1, and immune gene polymorphisms. It has been previously published that products generated from the majority of patients show high cytolytic activity and produce very similar in vitro levels of most cytokines. Since there is little variability in the ex vivo composition and cytokine production of the CTL019 product, but considerable heterogeneity in CRS in patients, it was hypothesized that the study would likely not find differences in the CTL019 product that will correlate with severity of CRS.

In conclusion, these data represent the largest and most comprehensive analysis to date of the clinical and biologic manifestations of CRS after CAR T cell therapy. This study identified and characterized cytokines that are associated with severe CRS and cytokines that can predict which patients will likely develop severe CRS before it happens. Early prediction will allow trials to determine if early intervention will mitigate toxicity without impacting efficacy. Based on the exciting efficacy seen with CAR T cells in early phase trials, their use is rapidly expanding from a select number of tertiary care institutions to a larger number of centers. Accordingly, understanding and reducing toxicity is paramount and these data provide significant novel information that may help achieve that goal.

Example 3: Supplemental Methods and Results

Trial Design

Laboratory and clinical data was collected from patients treated on 3 clinical trials designed to assess the safety and feasibility of CTL019 T cell therapy in relapsed/refractory CD19+ malignancies. Clinicaltrials.gov: NCT01626495, NCT 02030847 and NCT01029366. Written informed consent was obtained from all subjects or their legal guardian according to the Eligibility criteria for the three trials are included on the Clinicaltrials.gov website and are also previously published. Of note, patients with active graft versus host disease, active CNS involvement with leukemia (CNS3), an uncontrolled infection, active hepatitis B or C, or HIV were excluded. Patients who had a prior allogeneic stem cell transplant were eligible provided it had been at least 6 months since the transplant and the patient did not require immunosuppression at the time of enrollment. Study procedures including details of leukapheresis and types of lymphodepleting chemotherapy are previously published (Maude, NEJM Oct. 16, 2014; 371(16):1507-1517). Patients were infused with $1-10 \times 10^7$ T cells/kg ($5-50 \times 10^8$ T cells for patients over 50 kg) over 1-3 days as previously described. Details on response to therapy for the first 30 subjects included in this report are also previously published.

General Laboratory Statement

CTL019 T cells were produced under principles of current Good Manufacturing Practices. Clinical laboratory studies, including ferritin, C-reactive protein (CRP), alanine aminotransferase (ALT), aspartate aminotransferase (AST), blood urea nitrogen (BUN), creatinine (Cr), complete blood count (CBC) with differential, prothromin time (PT), partial thromboplastin time (PTT), and fibrinogen were performed in Clinical Laboratory Improvement Amendments (CLIA)-certified and College of American Pathologist (CAP)-accredited clinical laboratories.

Production of CTL019 T Cells

Peripheral blood mononuclear cells (PBMCs) were collected by leukapheresis. T cells were enriched, washed, and expanded by addition of anti-CD3/CD28-coated paramagnetic beads for activation of T cells. The lentiviral vector containing the previously described anti-CD19-BB-ζ transgene was added at the time of cell activation and was washed out on day 3 after culture initiation. Cells were expanded on a rocking platform device (WAVE Bioreactor System) for 8 to 12 days. On the final day of culture, the beads were removed by passage over a magnetic field and the CTL019 cells were harvested and cryopreserved in infusible cryomedium. Final product release criteria in the IND included the following: cell viability≥70%, CD3+ cells≥80%, residual paramagnetic anti-CD3/CD28-coated paramagnetic beads≤100 per 3×10$^6$ cells, Endotoxin≤3.5 EU/mL, *Mycoplasma* negative, Bacterial and fungal cultures negative, residual bovine serum albumin≤1 µg/mL, VSV-G DNA as a surrogate marker for replication competent lentivirus≤50 copies perm DNA, transduction efficiency by flow cytometry≥2%, transduction efficiency by vector DNA sequence 0.02 to 4 copies per cell.

Sample Processing for Non-Clinical Laboratory Studies

Peripheral blood and bone marrow samples were collected in lavender top (K2EDTA) or red top (no additive) vacutainer tubes (Becton Dickinson). Lavender top tubes were delivered to the laboratory within 2 hours of the sample draw, or shipped overnight at room temperature in insulated containers as described. Samples were processed within 16 hours of drawing according to the established SOP. Peripheral blood (PBMC) and bone marrow (BMMC) mononuclear cells were purified, processed, and stored at −140° C. Red top tubes were processed within 2 hours of the draw, including coagulation time; serum was isolated by centrifugation, aliquoted in single use 130 µL aliquots and stored at −80° C.

Methods for Luminex 14 Plex and 30 Plex Assays

Human cytokine magnetic 30-plex panel catalog number LHC6003M was purchased from Life Technologies (Carlsbad, Calif.). The following analytes are in the panel (IL-1RA, FGF-Basic, MCP-1, G-CSF, IFN-γ, IL-12, IL-13, IL-7, GM-CSF, TNF-α, IL-1β, IL-2, IL-4, IL-5, IL-6, IFN-α, IL-15, IL-10, MIP-1 a, IL-17, IL-8, EGF, HGF, VEGF, MIG, RANTES, Eotaxin, MIP-1(3, IP-10, IL-2R). Human soluble cytokine receptor magnetic bead 14-plex panel catalog number HSCRMA32KPX14 was purchased from EMD Millipore (Darmstadt, Germany). The following analytes are in the panel (sCD30, sEGFR, sgp130, sIL-1RI, sIL-1RII, sIL-2Rα, sIL-4R, sIL-6R, sRAGE, sTNFRI, sTNFRII, sVEGFR1, sVEGFR2, sVEGFR3). Serum samples cryopreserved at −80° C. from day −4 to day 28 were thawed and analyzed according to the manufacturers' protocols. Assay plates were measured using a FlexMAP 3D instrument (Luminex, Austin, Tex.), and data acquisition and analysis were done using xPONENT software (Luminex). Data quality was examined based on the following criteria. The standard curve for each analyte has a R2 value>0.95 with or without minor fitting using xPONENT software. Non-extrapolated data from low bead counts that also have CV (coefficient of variation)>20% were flagged. For the 14-plex kit, >90% of the results for the two control samples included in the kit was required to be within the expected ranges provided by the manufacturer. No further tests were done on samples with results out of range low (<OOR) and substituted with half of the lower end of the standard curve for data analysis. Samples with results that were out of range high (>OOR) or greater than two times the standard curve maximum value (SC max) were re-tested at higher dilutions. Results that passed the above quality controls or retests were used in translational correlative studies.

Collection Time Points.

Cytokines, CBC, ALT, AST, BUN, Cr, ferritin, CRP, and LDH were collected on the following days based on study. Protocols also allowed for additional collection of samples when patients were ill. Of note, ferritin and CRP were not included when the study first opened. Baseline ferritin was not obtained in 2 children. Baseline CRP was not obtained in 3 children and 2 adults. Ferritin was collected on CHP959 with the first subject enrolled, but not until day 11 and this subject only had 3 time-points collected in the first 35 days. After learning the importance of ferritin, the second, third, and fourth CHP959 subjects had ferritin checked more frequently 8, 24, and 9 times, respectively over the first 35 days. By subject 5, ferritin was collected routinely on the same schedule as the other clinical labs and cytokines. CRP was not sent on the first two subjects at any time-point. By subject 3, CRP was tested on the same schedule as the other clinical labs. Details on coagulation studies are provided below.

Baseline Disease Burden

The children on this study had a bone marrow aspirate and biopsy, as well as minimal residual disease testing sent immediately prior to infusion. Aspirates and biopsies were quantified for amount of disease burden by hematopathologists. MRD was performed as previously described (Borowitz M J, et al. Clinical significance of minimal residual disease in childhood acute lymphoblastic leukemia and its relationship to other prognostic factors: a Children's Oncology Group study. Blood. Jun. 15, 2008; 111(12):5477-5485, Weir E G, et al. A limited antibody panel can distinguish B-precursor acute lymphoblastic leukemia from normal B precursors with four color flow cytometry: implications for residual disease detection. Leukemia. April 1999; 13(4): 558-567). One child did not have a bone marrow biopsy performed and 4 children had bone marrow biopsies that disease could not be accurately quantified. All children had bone marrow aspirates for morphology and 5 children did not have central MRD. Disease burden was considered as both a continuous and dichotomous variable. Baseline disease burden was defined by taking the highest value (percent blasts) either by MRD or morphology on aspirate or biopsy.

Application of the CRS Prediction Model: An Example

This section shows how to apply prediction models described herein to obtain a prediction for severe CRS status for Subject 136 from the pediatric protocol. This subject had severe (grade 4) CRS.

Model A: Top Regression Model for Combined Cohort

Subject 136 had a day 1-3 peak (Pk3) of 272,292.6, 59.9067, and 57.0324 for sgp130, IFNγ, and IL1RA, respectively. After taking the common logarithm (base 10) and using the respective estimates in the 1st row of Table 3 of Teachey et al., x=(13.8712*5.4350)+(2.4626*1.7775)+(−1.6559*1.7561)−75.3502=1.5095, exp(x)=4.5245, and exp(x)/(1+exp(x))=the predicted probability=0.8190. Since this is greater than the cutoff of 0.3623 in Table 3, the model (correctly) predicts severe CRS.

Model B: Top Tree Model for Combined Cohort sgp130Pk3=272,292.6 is greater than cutoff of 218,179, and MCP1Pk3=1,053.2294 is less than the cutoff of 4,636.52, and EotaxinPk3=18.0830 is less than the cutoff of 29.0902, so the model (correctly) predicts severe CRS.

Model C: Top Regression Model for Pediatric Cohort

IFNγPk3 as above; IL13Pk3 was 1.556 and MIP1αPk3 was 25.886. After taking the common logarithm and using the estimates in the 3rd row of Table 3, x=(8.483*1.777)+(−5.599*0.192)+(−16.343*1.413)+15.742=6.652. exp (6.652)=774.38, and exp(x)/(1+exp(x))=the predicted probability=0.999. Since this is greater than the cutoff of 0.3288, the model (correctly) predicts severe CRS.

Model D: Top Tree Model for Pediatric Cohort

Subject 136 had IL10Pk3=37.4598, which was greater than the cutoff of 11.747; and a disease burden of 98.5 is greater than a cutoff of 51%, so model (correctly) predicts severe CRS.

Model E: Classifier Using Factors from Top Pediatric Logistic Regression Model

IFNγPk3=59.9067 was greater than the cutoff of 27.6732 and MIP1αPk3=25.8859 was less than the cutoff of 30.1591, so model (correctly) predicts severe CRS.

Supplemental Results

Definition, Time, and Duration of Fever

Start of CRS was defined as the day of first fever for patients who had fever relative to infusion of CTL019. Per protocol, for the pediatric cohort a fever was defined as 38.6° C. (101.5° F.) or higher. Per protocol, for the adult cohort a fever was defined as 38.0° C. (100.5° F.) or higher. For consistency, for the purposes of the analysis start of CRS was defined as the day with the first fever>=38.0° C. for all subjects. Of note, the first day of CRS would not change for any pediatric subject using a definition of >=38.0° C. or >=38.5° C. Stop of CRS was defined as the first day of no fever>38.0° C.

Median time to first fever was earlier in patients with grade 4-5 CRS as compared to grade 1-3 CRS. This difference was not statistically significant in the total cohort or the adults, but there was a significant difference in the children (median 4 days vs 1 day; p<0.05). While the median time to first fever was statistically significant in the children, time to first fever is not a clinically meaningful marker of CRS severity, as there were too many outliers. There was no difference in total number of days febrile based on CRS grade in children or adults. Patients with severe CRS were treated with the IL6R inhibitor tocilizumab, which typically caused rapid defervescence.

Details on Comorbid Infections

A total of 6 patients had co-morbid new infections that were identified in the first month after infusion with CTL019. In the pediatric cohort these did not appear to affect severity of CRS. In the adult cohort, infections likely contributed to mortality.

Additional Details on Utility of CRP in CRS Prediction

Early CRP elevation was associated with grade 4-5 CRS (p=0.02), but, contrary to other published reports we did not find early assessment of CRP in the first three days following CTL019 infusion was useful in predicting severity of CRS (AUC=0.73). For example, considering CRP as a screen for high-risk cases, a CRP>6.8 mg/dl would have identified only 72% of the cases and had a positive predictive value (PPV) of 43%. Higher cut-offs produced lower PPV. Median CRP for the first 3 days after infusion was 4.8 mg/dl (range: <0.50-36.3) in grade 0-3 and 13.6 mg/dl (2.9-33.2) in grade 4-5 CRS (p=0.022). There were patients with grade 0-3 CRS who had marked early elevation in CRP, including 10/34 patients with grade 0-3 CRS whose peak CRP within the first 3 days of infusion was >10 mg/dl, while 6/11 patients with grade 4-5 CRS had a peak CRP>10 mg/dl (PPV=0.375). Early measurement of CRP was not routinely performed when the study first opened and a CRP between days 1-3 was not available for 3 patients with grade 4-5 CRS and 3 patients with grade 0-3 CRS.

Details on Normal Donor Cohort

Serum was collected from 10 normal healthy volunteers. 5 were males and 5 were females. Age median (range): 40 (25-65).

Additional Details on Coagulopathy

PT, PTT, and fibrinogen were only obtained when clinically indicated. Accordingly, there is a definite selection bias toward the children and adults who became ill. Fibrinogen was sent in 10 of 11 patients in the pediatric cohort and a subset of patients in the adult cohort with CRS 4-5 and 15 of 28 patients in the pediatric cohort and a subset of in the adult cohort with CRS 0-3. Fibrinogen was checked at one time in a subset of patients, twice in a subset of patients, 3 times in a subset of patients, 4 or more times in a subset of patients. PT and PTT were sent in a subset of children and a subset of adults with CRS4-5 and a subset of children and a subset of adults with CRS 0-3. PT and PTT were checked one time in a subset of patients, twice in a subset of patients, 3 times in a subset of patients and 4 or more times in a subset of patients. Unlike patients who develop DIC or liver failure, patients with HLH often develop a coagulopathy that is striking for the marked degree of hypofibrinogenemia relative to modest elevations in PT/INR or PTT. This pattern was also seen in the pediatric cohort with grade 4 CRS. Adults also developed coagulopathy; however, there were no differences when comparing CRS 4-5 vs CRS 0-3.

Additional Statistical Analyses

Of note, for a subset of the patients the CRS was very short and the timed sequence of cytokine collection did not include the short window the patient was febrile. In order to ensure these patients did not falsely skew results, we also completed statistical analysis excluding these patients and found it did not change any of the results. The clinical protocol mandated collection of cytokines at scheduled time-points (see supplemental methods). Patients who developed severe CRS often had additional laboratory values sent. In order to ensure results were not biased by the additional measurements, we performed a per-protocol analysis and found the same cytokines that were differentially elevated based on CRS grade (data not shown).

Example 4: Biomarker Profiling to Differentiate Sepsis from Cytokine Release Syndrome in Chimeric Antigen Receptor T-Cell Therapy for Acute Lymphoblastic Leukemia (ALL)

Chimeric antigen receptor (CAR)-modified T cells with CD19 specificity (CTL019) are a highly effective novel immune therapy for relapsed/refractory ALL. Cytokine release syndrome (CRS) is the most significant and in some cases a life-threatening toxicity. These patients are often neutropenic and immunosuppressed and at high risk for sepsis. In addition, there have been cases where concurrent infectious complications potentially fueled underlying CRS leading to hypotension and hypoxia refractory to anti-cytokine directed therapies (Frey et al. abstract 2296, ASH 2014). Discriminating between sepsis and CRS can be a significant clinical challenge in the critical time-window required to initiate effective therapy, especially since the treatments for CRS, including anti-cytokine therapies and corticosteroids, may worsen severe infections. An extensive study of 43 cytokines and soluble cytokine receptors, and clinical biomarkers in a cohort of 63 CTL019-treated ALL patients showed that peak levels of 24 cytokines in the first month after infusion were highly associated with severe CRS, and CRS predictive models were described (Teachey et al. Cancer Discovery, Jun. 1, 2016 6; 664, which is herein incorporated by reference in its entirety).

This Example compares biomarker profiles in CRS and sepsis, and identifies a profile to discriminate between the two clinical syndromes, particularly at time of ICU admission. The Example evaluates 50 cytokines, soluble receptors, and other serum biomarkers in 66 adult and pediatric patients treated with CTL019 (ALL-CRS cohort), 15 patients not treated with CTL019 but who developed sepsis leading to ICU admission (sepsis cohort), and 10 normal healthy children (control cohort). Of the 66 patients treated with CTL019 and who developed CRS, 30 (45%) required ICU admission. The biomarkers tested included the ones described herein plus a panel of seven additional sepsis-associated biomarkers (Angiopoietin 2, [ANG2] sCD163, Pentraxin 3 [PTX3], sCD14, PAI-1, P-selectin, ICAM-1).

After adjusting for multiple comparisons, the following biomarkers were significantly elevated in sepsis compared to normal subjects: ANG2, GCSF, IFNα, IL1RA, IL4, IL6, MIG, MIP1α, PTX3, TNFα, sCD163, sCD30, sIL-1RI, sIL-1RII, sIL-2Rα, sIL-4R, sRAGE, sTNFRI, sTNFRII, sVEGFR1, sVEGFR2, sVEGFR3, and VEGF, whereas IL13 and RANTES were significantly lower in sepsis. In ALL-CRS subjects within 72 hours of ICU admission following CTL019 therapy (N=29), 23 biomarkers were significantly different compared to sepsis after adjusting for multiple comparisons; 16 were elevated in CRS: GM-CSF, HGF, IFN-γ, IFN-α, IL-10, IL-15, IL-5, IL-6, IL-8, IP-10, MCP1, MIG, MIP-1β, sIL-2Rα, sTNFRI, and sTNFRII; whereas 7 were elevated in sepsis subjects: CD163, IL-1β, sCD30, sIL-4R, sRAGE, sVEGFR-1, and sVEGFR-2. FIG. 15 shows representative plots for sCD163 (elevated in sepsis) and IP-10 (elevated in CRS). These comprehensive profiling data provide novel insights into CRS biology and importantly, help discriminate between CRS and sepsis in patients who become critically ill after receiving CAR T cell therapy. These data have direct translational therapeutic relevance.

Example 5: Posterior Reversible Encephalopathy Syndrome (PRES) after Infusion of Anti-BCMA CAR T Cells (CART-BCMA) for Multiple Myeloma: Successful Treatment with Cyclophosphamide Neurologic toxicity has been observed in patients treated with anti-CD19 chimeric antigen receptor (CAR) T cells and the anti-CD19/anti-CD3 bispecific T-cell engager blinatumomab. Reported neurotoxicities include both focal deficits (e.g., cranial nerve palsy or hemiparesis) and global abnormalities (e.g., generalized seizures, confusion), often associated with systemic cytokine release syndrome (CRS) but also observed after recovery from or in absence of CRS. CART-BCMA involves ex-vivo-expanded autologous T cells transduced via lentiviral vector to express a 4-1BB/CD3-zeta-based CAR specific for B Cell Maturation Antigen. This Example reports clinical characteristics and management of a severe neurotoxicity observed during a phase 1 study of CART-BCMA in multiple myeloma (MM) (NCT02546167).

The subject is a 55-year-old female with high-risk IgA lambda MM progressing after 4 prior lines of therapy. Pre-treatment disease manifestations included cytopenias and extramedullary plasmacytomas of the pleura and paravertebral musculature. Bone marrow (BM) was >95% occupied by BCMA+ plasma cells. Pre-treatment brain MRI showed pachymeningeal thickening and enhancement over the left cerebral convexity, possibly due to direct extension of calvarial MM lesions. Pre-treatment examination by a neurologist and CSF cytology showed no evidence of CNS MM.

The subject received 2×10$^8$ CART-BCMA cells, 40% of the planned dose, over two consecutive days, without preceding lymphodepleting chemotherapy; a third planned infusion was held due to fevers. Over the next 4 days, fevers persisted, and hypoxia, pancytopenia and delirium developed. Brain MRI and lumbar puncture on day 4 showed no new abnormalities. Evaluation for infection was negative. These symptoms corresponded with rise in serum IL-6 and other CRS-associated biomarkers. On day 6 after CART-BCMA infusion, two tocilizumab doses were administered for CRS, which led to decline in serum IL-6 and resolution of fevers and hypoxia (FIG. 16, circles and triangles).

On day 8, the subject became obtunded, prompting intubation and initiation of corticosteroids (methylprednisolone 1000 mg×1, then hydrocortisone 100 mg every 8 hours). Her mental status improved over the subsequent two days, and by day 11 she was extubated, alert, and off steroids. On day 12 she developed a generalized seizure and was again intubated for airway protection and treated with antiepileptic drugs (AED). She again improved and was extubated but, on day 15, developed status epilepticus that required five AEDs to control. Repeat brain MRI showed new diffuse sulcal, cortical, and subcortical T2/FLAIR signal abnormality involving the bilateral frontal, parietal, occipital, posterior temporal, and cerebellar hemispheres, with sulcal effacement concerning for cerebral edema. This deterioration was not associated with recurrence of fevers, other systemic CRS signs/symptoms, or hypertension, but it coincided with striking rise in frequency of circulating, activated (HLA-DR+) CART-BCMA cells (FIG. 16, inverted triangles). Serum levels of CRS-related cytokines continued to decrease, but CSF obtained on day 16 showed marked elevation in IL-6, IL-8, and other CRS-associated cytokines compared to both day-16 serum and day-4 CSF (FIG. 16, squares). CART-BCMA cells were detected in CSF. High-dose methylprednisolone was restarted on day 15 without clinical improvement. On day 17, cyclophosphamide 1.5 g/m$^2$ was administered to reduce CART-BCMA cells. Beginning on day 18, alertness and responsiveness improved substantially, and she was extubated on day 20. Corticosteroids were gradually tapered. MRI on day 23 showed near-resolution of cerebral and cerebellar signal abnormalities, which were completely gone on repeat MRI 4 weeks later. Cognitive functioning recovered without long-term neurologic sequelae other than fatigue and mild concentration difficulty attributed to effects of AEDs. The last neurologic symptom to recover was mild difficulty processing visual information. Despite administration of cyclphosphamide and a prolonged corticosteroid course, CART-BCMA cells remained detectable in both blood and marrow at last evaluation, 164 days after infusion, and patient achieved a VGPR lasting 5 months.

Given the rapid reversibility and MRI appearance, this neurologic syndrome was felt to be most consistent with posterior reversible leukoencephalopathy syndrome (PRES), possibly due to high levels of CRS-related cytokines in CSF, as opposed to encephalitis from direct CART-BCMA cytotoxicity against neuronal tissue. PRES developed amidst improvement in systemic CRS, suggesting a CNS-localized CRS, which may have been due to occult CNS MM encountered by rising CART-BCMA frequency and/or failure of tocilizumab to block IL-6 receptor in the CNS. While steroids achieved only transient clinical improvement, the syndrome resolved rapidly after cytoreduction with cyclophosphamide, without completely eradicating infused CART-BCMA cells, suggesting that this strategy could be considered for cases of life-threatening CAR T cell neurotoxicity.

Example 6: Treatment with Chimeric Antigen Receptor Modified T Cells Directed Against CD19 (CTL019) Results in Durable Remissions in Patients with Relapsed or Refractory Diffuse Large B Cell Lymphomas of Germinal Center and Non-Germinal Center Origin, "Double Hit" Diffuse Large B Cell Lymphomas, and Transformed Follicular to Diffuse Large B Cell Lymphomas Background:

The cell of origin (COO) of diffuse large B cell lymphoma (DLBCL), germinal center (GC) or non-germinal center (NGC), may have prognostic significance for treatment outcome in first-line and relapsed settings (Lenz et al NEJM 2008; Thieblemont et al JCO 2011). "Double hit" DLBCL (DHL), defined by chromosomal breakpoints affecting the MYC/8q24 locus and a second oncogene locus and arising either from transformation of follicular lymphoma (FL) or de novo, has no effective therapy in the relapsed setting. Since new therapies are needed for poor prognostic groups of relapsed DLBCL patients (pts), we examined the efficacy of treatment with autologous T cells genetically modified to express a chimeric antigen receptor consisting of an external anti-CD19 single chain murine antibody domain with CD3ζ and 4-1BB signaling domains (CTL019 cells) in pts with relapsed or refractory GC- and NGC-DLBCL, DHL, and transformed FL as part of an ongoing phase IIa clinical trial (NCT02030834).

Methods:

Eligible pts had CD19+ DLBCL with measurable residual disease after primary and salvage therapies, were not eligible for autologous stem cell transplant (ASCT) or had relapsed/residual disease after ASCT, had a limited prognosis (<2 years anticipated survival), and had responsive or stable disease with most recent therapy. COO of DLBCL was determined by immunohistochemistry using Hans' algorithm (Hans et al Blood 2004). Fluorescence in-situ hybridization was performed on diagnostic tissue using Vysis MYC (8q24), BCL2 (18q21) and BCL6 (3q27) break apart probes to determine DHL. DHL was defined by a MYC locus chromosomal translocation with a second translocation involving either BCL2 or BCL6. After steady state apheresis to collect peripheral blood leukocytes, pts received lymphodepleting chemotherapy based on clinical features and past therapies. One to 4 days after chemotherapy, pts received a single intravenous dose of CTL019 cells. Following CTL019 cells, pts received no further therapy. Initial tumor response assessment was performed 3 months after T cell infusion using International Working Group response criteria. Enrollment started in February 2014; data are reported through Jul. 24, 2016.

Results:

13 pts with DLBCL are enrolled and evaluable for response (7 pts GC, 5 pts NGC, 1 undetermined). The median age is 59 years (range: 25-77), male:female ratio 10:3, median number of prior therapies 5 (range: 2-8), and number of pts with prior transplant 7 (54%). At enrollment, Ann Arbor stages were: Stage IV 8 pts (61%), Stage III 1 pt (8%), and Stage II 3 pts (23%) Stage IE 1 pt (8%); 3 pts (23%) had bone marrow involvement. LDH was increased in 8 pts (62%). ECOG PS was 0 in 4 pts (31%) and 1 in 9 pts (69%). Lymphodepleting chemotherapy regimens were bendamustine (90 mg/m²×2; 1 pt), cyclophosphamide (1 gm/m²; 2 pts), radiation-cyclophosphamide (4,000 cGy-750 mg/m²; 1 pt), modified-EPOCH (3 pts), and hyper-fractionated cyclophosphamide (300 mg/m² q12 hours×6; 6 pts). 12 pts received 5.00E+08 (5.10-6.75E+06 cells/kg) CTL019 cells; 1 pt received 1.93E+08 (3.10E+06 cells/kg). Median peak CTL019 cell expansion in blood occurred 7 days after infusion (range: 2-28 days); there is no difference in peak expansion between responders and non-responders or pts with GC- or NGC-DLBCL. Cytokine release syndrome occurred in 9 pts (8 grade 2; 1 grade 3) and did not predict response. Transient neurotoxicity included delirium in 2/13 pts (1 grade 2; 1 grade 3) and cognitive disturbance in 1/13 pts (1 grade 1). At 3 months post CTL019 infusion, overall response rate (ORR) is 52% (7/13 pts); ORR for GC 71% (5/7 pts) and NGC 40% (2/5 pts). Complete response rate (CR) at 3 months is 38% (5/13 pts); CR for GC 43% (3/7 pts) and NGC 40% (2/5 pts). Best response for all pts is CR in 6 of 13 pts (46%); CR for GC 57% (4/7 pts) and NGC 40% (2/5 pts). 3 of 7 pts with GC-DLBCL had transformed FL and all 3 achieved CR; 2 of 7 pts with GC-DLBCL had DHL and both achieved CR. To date, no pt achieving CR has relapsed. 2 of 5 pts with NGC-DLBCL had T-cell rich DLBCL; neither patient responded to CTL019. Median progression-free survival (PFS) is 5.8 months (mo) for all pts, 3.0 mo for NGC pts, and not reached for GC pts (PFS 57.1% [95% CI: 17.2%-83.7%] at median follow up 21.9 mo).

CONCLUSIONS

These results indicate that a single treatment with CTL019 cells is safe and efficacious in relapsed or refractory GC- and NGC-DLBCL, DHL, and transformed FL.

Example 7: IL-6 Receptor Polymorphisms Predict the Development of Treatment-Refractory Cytokine Release Syndrome after CART19 Therapy Using a dataset from adult ALL patients treated with CART19, single-nucleotide polymorphisms in IL-6R were identified that predict whether cytokine release syndrome (CRS) is refractory to treatment with the IL-6 receptor antagonist tocilizumab. The SNPs tested were: rs2228145 (main genetic variant), rs4329505 (Transition substitution SNP leading to higher sIL-6 levels with C/T vs T/T), rs12083537, rs4129267, and rs7529229 (Galicia J C, et al. Genes and Immunity 2004; 5:513-16; Ferreira R C, et al. PLOS One 2013; 9:e1003444). The major and minor alleles, frequencies, and impact on IL6 are set out in Table 17.

The SNP rs2228145 (which is located on exon 9 of the IL-6r gene on chromosome 1q21) represents an Asp358Ala substitution within the extracellular domain of IL-6R. The tocilizumab sensitivity of patients was determined and compared to their genotype at this locus (Table 18). This experiment indicated that having an A/A haplotype at rs2228145 was predictive of response to tocilizumab. This effect may be due to higher sIL-6R levels in non-A/A haplotypes.

The tocilizumab sensitivity of patients was determined and compared to their genotype at four additional SNP loci in IL-6R (Table 19).

Additional Tables

TABLE 15

CTCAE v 4.0 CRS grading scale.

| CRS grade | Characteristics |
|---|---|
| Grade 1 | Mild; No infusion interruption; No intervention |
| Grade 2 | Infusion interruption indicated but responds promptly to symptomatic treatment (e.g., antihistamines, NSAIDS, narcotics, IV fluids); prophylactic medications indicated for <=24 hrs |
| Grade 3 | Prolonged (e.g., not rapidly responsive to symptomatic medications and/or brief interruption of infusion); recurrence of symptoms following initial improvement; hospitalization indicated for clinical sequelae (e.g., renal impairment, pulmonary infiltrates) |
| Grade 4 | Life threatening consequences; pressor or ventilator support |

TABLE 16

NCI CRS grading scale.

| CRS grade | Characteristics |
|---|---|
| Grade 1 | Symptoms are not life threatening and require symptomatic treatment only; e.g., fever, nausea, fatigue, headache, myalgias, malaise |
| Grade 2 | Symptoms require and respond to moderate intervention; Oxygen requirement <40% or hypotension responsive to fluids or low dose pressors or Grade 2 organ toxicity |
| Grade 3 | Symptoms require and respond to aggressive intervention; Oxygen requirement >=40% or Hypotension requiring high dose or multiple pressors or grade 3 organ toxicity or grade 4 transaminitis |
| Grade 4 | Life threatening symptoms Requirement for ventilator support or Grade 4; organ toxicity (excluding transaminitis) |

TABLE 17

IL-6R SNP summary

| SNP | Incidence | Allele | Significance |
|---|---|---|---|
| rs2228145 (main variant) | Caucasian 35% AA 6% Asian 40% | Major: A Minor: C | sIL-6R levels: C/C > A/C > A/A |
| rs4329505 | Caucasian 18% AA 50% Asian 10% | Major: T Minor: C | sIL-6R levels: C/C > C/T > T/T |
| rs12083537 | Caucasian 15% AA 23% Asian 15% | Major: A Minor: G | sIL-6R levels: A/A > A/G > G/G |
| rs4129267 | Caucasian 35% AA 6% Asian 40% | Major: C Minor: T | sIL-6R levels: T/T > C/T > C/C |
| rs7529229 | Caucasian 36% AA 25% Asian 40% | Major: T Minor: C | IL-6R levels: C/C > T/C > T/T |

TABLE 18

Tocilizumab sensitivity of patients based on rs2228145 genotype.

| Variable | A/A (n = 10) | C/A (n = 5) + C/C (n = 1) |
|---|---|---|
| Developed CRS | 9/10 (90) | 6/6 (100) |
| Mean CRS Grade | 3.1 | 2.8 |
| CRS Grade 3-5 | 8/10 (80) | 5/6 (83) |
| CRS Grade 4-5 | 3/10 (33) | 1/6 (17) |
| Tocilizumab Responders* | 3/7 (43) | 0/3 (0) |
| Only required 1 dose of toci for CRS resolution | 2/7 (29) | 0/3 (0) |

TABLE 19

Tocilizumab sensitivity of patients based on genotype at rs4329505, rs12083537, rs4129267, or rs7529229.

| | rs4329505 | | rs12083537 | | rs4129267 | | rs7529229 | |
|---|---|---|---|---|---|---|---|---|
| Variable | T/T (n = 6) | C/T (n = 3) | A/A (n = 10) | A/G (n = 5) or G/G (n = 2) | C/C (n = 10) | C/T (n = 8) or T/T (n = 2) | T/T (n = 8) | C/T (n = 6) or C/C (n = 2) |
| Developed CRS | 6/6 (100) | 2/3 (67) | 10/10 (100) | 6/7 (86) | 9/10 (90) | 10/10 (100) | 7/8 (87) | 8/8 (100) |
| Mean CRS Grade | 3 | 2.3 | 3.2 | 3 | 3.1 | 2.9 | 3 | 2.9 |
| CRS Grade 3-5 | 5/6 (83) | 2/3 (67) | 9/10 (90) | 5/7 (71) | 8/10 (80) | 8/10 (80) | 6/8 (75) | 6/8 (75) |
| CRS Grade 4-5 | 1/6 (17) | 1/3 (33) | 2/10 (20) | 3/7 (43) | 3/10 (30) | 2/10 (20) | 1/8 (12) | 2/8 (25) |
| Tocilizumab Responders (Only required tocilizumab for treatment of CRS) | 1/5 (20) | 2/2 (100) | 2/7 (29) | 1/4 (25) | 3/6 (50) | 2/6 (33) | 1/5 (20) | 1/5 (20) |
| Only required 1 dose of toci for CRS resolution | 0/5 (0) | 2/2 (100) | 1/7 (14) | 1/4 (25) | 3/6 (50) | 0/6 (0) | 1/5 (20) | 0/5 (0) |

EQUIVALENTS

Other embodiments of the invention will be apparent to those skilled in the art from a consideration of the specification or practice of the invention disclosed herein. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (341 sequences)

SEQ ID NO: 1 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 2 - protein, 21 aa, Artificial Sequence
  source: /note="Description of Artificial Sequence: Synthetic peptide"
MALPVTALLLPLALLLHAARP

SEQ ID NO: 3 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 4 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 5 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 6 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 7 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 8 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 9 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 10 - protein, 10 aa, Artificial Sequence
  source: /note="Description of Artificial Sequence: Synthetic peptide"
GGGGSGGGGS

SEQ ID NO: 11 - DNA, 30 bp, Artificial Sequence
  source: /note="Description of Artificial Sequence: Synthetic oligonucleotide"
ggtggcggaggttctggaggtggaggttcc

SEQ ID NO: 12 - protein, 24 aa, Artificial Sequence
  source: /note="Description of Artificial Sequence: Synthetic peptide"
IYIWAPLAGTCGVLLLSLVITLYC

SEQ ID NO: 13 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 14 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 15 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 16 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 17 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 18 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 19 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 20 - protein, 112 aa, Artificial Sequence
  source: /note="Description of Artificial Sequence: Synthetic polypeptide"
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 21 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - protein, 5 aa, Artificial Sequence
  source: /note="Description of Artificial Sequence: Synthetic peptide"
GGGGS

SEQ ID NO: 23 - DNA, 30 bp, Artificial Sequence; identical to SEQ ID NO: 11
  source: /note="Description of Artificial Sequence: Synthetic oligonucleotide"

SEQ ID NO: 24 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 25 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 26 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 27 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 28 - protein, 40 aa, Artificial Sequence
  source: /note="Description of Artificial Sequence: Synthetic polypeptide"
  MISC_FEATURE (1)..(40): /note="This sequence may encompass 1-10 "Gly-Gly-Gly-Ser" repeating units"
GGGSGGGSGGGSGGGSGGGSGGGSGGGSGGGSGGGSGGGS

SEQ ID NO: 29 - protein, 20 aa, Artificial Sequence
  source: /note="Description of Artificial Sequence: Synthetic peptide"
GGGGSGGGGSGGGGSGGGGS

SEQ ID NO: 30 - protein, 15 aa, Artificial Sequence
  source: /note="Description of Artificial Sequence: Synthetic peptide"
GGGGSGGGGSGGGGS

SEQ ID NO: 31 - protein, 4 aa, Artificial Sequence
  source: /note="Description of Artificial Sequence: Synthetic peptide"
GGGS

SEQ ID NO: 32 - DNA, 2000 bp, Artificial Sequence
  source: /note="Description of Artificial Sequence: Synthetic polynucleotide"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 33 - DNA, 150 bp, Artificial Sequence
  source: /note="Description of Artificial Sequence: Synthetic polynucleotide"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 34 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 100 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttt

SEQ ID NO: 36 - DNA, 5000 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 37 - DNA, 1000 bp, Artificial Sequence
  source: /note="Description of Artificial Sequence: Synthetic polynucleotide"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 38 - DNA, 400 bp, Artificial Sequence
  source: /note="Description of Artificial Sequence: Synthetic polynucleotide"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 39 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 40 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 41 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 42 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 43 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 44 - DNA, 64 bp, Artificial Sequence
  source: /note="Description of Artificial Sequence: Synthetic oligonucleotide"
aaaaaaaaaaaaaaaaaaaaaaaaaaaaaaaaaaaaaaaaaaaaaaaaaaaaaaaaaaaaaaaa

SEQ ID NO: 45 - protein, 18 aa, Artificial Sequence
  source: /note="Description of Artificial Sequence: Synthetic peptide"
GSTSGSGKPGSGEGSTKG

SEQ ID NO: 46 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 47 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 48 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 49 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 50 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 51 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 52 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 53 - DNA, 100 bp, Artificial Sequence
  source: /note="Description of Artificial Sequence: Synthetic polynucleotide"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 54 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 55 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 56 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 57 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 58 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 59 - DNA, 1458 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 60 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 61 - DNA, 1458 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 62 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 63 - protein, 247 aa, Artificial Sequence; identical to SEQ ID NO: 39
  source: /note="Description of Artificial Sequence: Synthetic polypeptide"

SEQ ID NO: 64 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggcggaggcgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 65 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 66 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggagggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 67 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 68 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 69 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 70 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggcggtgggtcagaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 71 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 72 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggtgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 73 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 74 - DNA, 1473 bp, Artificial Sequence; identical to SEQ ID NO: 72
  source: /note="Description of Artificial Sequence: Synthetic polynucleotide"

SEQ ID NO: 75 - protein, 491 aa, Artificial Sequence; identical to SEQ ID NO: 73
  source: /note="Description of Artificial Sequence: Synthetic polypeptide"

SEQ ID NO: 76 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 77 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 78 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 79 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 80 - DNA, 1458 bp, Artificial Sequence
  source: /note="Description of Artificial Sequence: Synthetic polynucleotide"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 81 - protein, 486 aa, Artificial Sequence; identical to SEQ ID NO: 54
  source: /note="Description of Artificial Sequence: Synthetic polypeptide"

SEQ ID NO: 82 - protein, 119 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 83 - protein, 111 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 84 - protein, 18 aa, Artificial Sequence
  source: /note="Description of Artificial Sequence: Synthetic peptide"
GSTSGSGKPGSGEGSTKG

SEQ ID NO: 85 - protein, 242 aa, Artificial Sequence; identical to SEQ ID NO: 52
  source: /note="Description of Artificial Sequence: Synthetic polypeptide"

SEQ ID NO: 86 - protein, 244 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRS

SEQ ID NO: 87 - protein, 464 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 88 - protein, 246 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 89 - protein, 439 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRL

SEQ ID NO: 90 - protein, 819 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 91 - protein, 245 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 92 - protein, 467 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 93 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 94 - DNA, 717 bp, Artificial Sequence
  source: /note="Description of Artificial Sequence: Synthetic polynucleotide"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 95 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 96 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 97 - protein, 483 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 98 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 99 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 100 - DNA, 738 bp, Artificial Sequence
  source: /note="Description of Artificial Sequence: Synthetic polynucleotide"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 101 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 102 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 103 - protein, 490 aa, Artificial Sequence
  source: /note="Description of Artificial Sequence: Synthetic polypeptide"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 104 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 105 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 106 - DNA, 732 bp, Artificial Sequence
  source: /note="Description of Artificial Sequence: Synthetic polynucleotide"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 107 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 108 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 109 - protein, 488 aa, Artificial Sequence
  source: /note="Description of Artificial Sequence: Synthetic polypeptide"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 110 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 111 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 112 - DNA, 729 bp, Artificial Sequence
  source: /note="Description of Artificial Sequence: Synthetic polynucleotide"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 113 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 114 - protein, 819 aa, Artificial Sequence; identical to SEQ ID NO: 90
  source: /note="Description of Artificial Sequence: Synthetic polypeptide"

SEQ ID NO: 115 - protein, 245 aa, Artificial Sequence; identical to SEQ ID NO: 91
  source: /note="Description of Artificial Sequence: Synthetic polypeptide"

SEQ ID NO: 116 - protein, 467 aa, Artificial Sequence; identical to SEQ ID NO: 92
  source: /note="Description of Artificial Sequence: Synthetic polypeptide"

SEQ ID NO: 117 - protein, 5 aa, Artificial Sequence
  source: /note="Description of Artificial Sequence: Synthetic peptide"
DYGVS

SEQ ID NO: 118 - protein, 16 aa, Artificial Sequence
  source: /note="Description of Artificial Sequence: Synthetic peptide"
VIWGSETTYYNSALKS

SEQ ID NO: 119 - protein, 16 aa, Artificial Sequence
  source: /note="Description of Artificial Sequence: Synthetic peptide"
VIWGSETTYYSSSLKS

SEQ ID NO: 120 - protein, 16 aa, Artificial Sequence
  source: /note="Description of Artificial Sequence: Synthetic peptide"
VIWGSETTYYQSSLKS

SEQ ID NO: 121 - protein, 16 aa, Artificial Sequence
  source: /note="Description of Artificial Sequence: Synthetic peptide"
VIWGSETTYYNSSLKS

SEQ ID NO: 122 - protein, 12 aa, Artificial Sequence
  source: /note="Description of Artificial Sequence: Synthetic peptide"
HYYYGGSYAMDY

SEQ ID NO: 123 - protein, 11 aa, Artificial Sequence
  source: /note="Description of Artificial Sequence: Synthetic peptide"
RASQDISKYLN

SEQ ID NO: 124 - protein, 7 aa, Artificial Sequence
  source: /note="Description of Artificial Sequence: Synthetic peptide"
HTSRLHS

SEQ ID NO: 125 - protein, 9 aa, Artificial Sequence
  source: /note="Description of Artificial Sequence: Synthetic peptide"
QQGNTLPYT

SEQ ID NO: 126 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 127 - protein, 487 aa, Artificial Sequence
  source: /note="Description of Artificial Sequence: Synthetic polypeptide"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 128 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 129 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 130 - DNA, 747 bp, Artificial Sequence
  source: /note="Description of Artificial Sequence: Synthetic polynucleotide"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 131 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 132 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 133 - protein, 493 aa, Artificial Sequence
  source: /note="Description of Artificial Sequence: Synthetic polypeptide"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 135 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 136 - DNA, 738 bp, Artificial Sequence
  source: /note="Description of Artificial Sequence: Synthetic polynucleotide"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 137 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 138 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 139 - protein, 490 aa, Artificial Sequence
  source: /note="Description of Artificial Sequence: Synthetic polypeptide"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 140 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 141 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 142 - DNA, 741 bp, Artificial Sequence
  source: /note="Description of Artificial Sequence: Synthetic polynucleotide"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 143 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 144 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 145 - protein, 491 aa, Artificial Sequence
  source: /note="Description of Artificial Sequence: Synthetic polypeptide"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 146 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 147 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 148 - DNA, 714 bp, Artificial Sequence
  source: /note="Description of Artificial Sequence: Synthetic polynucleotide"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 149 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 150 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 151 - protein, 482 aa, Artificial Sequence
  source: /note="Description of Artificial Sequence: Synthetic polypeptide"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 152 - DNA, 1446 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 153 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 154 - DNA, 717 bp, Artificial Sequence
  source: /note="Description of Artificial Sequence: Synthetic polynucleotide"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 155 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 156 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 157 - protein, 483 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 158 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 159 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 160 - DNA, 723 bp, Artificial Sequence
  source: /note="Description of Artificial Sequence: Synthetic polynucleotide"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 161 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 162 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 163 - protein, 485 aa, Artificial Sequence
  source: /note="Description of Artificial Sequence: Synthetic polypeptide"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 165 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 166 - DNA, 717 bp, Artificial Sequence
  source: /note="Description of Artificial Sequence: Synthetic polynucleotide"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 167 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 168 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 169 - protein, 483 aa, Artificial Sequence
  source: /note="Description of Artificial Sequence: Synthetic polypeptide"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 170 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 171 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 172 - DNA, 738 bp, Artificial Sequence
  source: /note="Description of Artificial Sequence: Synthetic polynucleotide"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 173 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 174 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 175 - protein, 490 aa, Artificial Sequence
  source: /note="Description of Artificial Sequence: Synthetic polypeptide"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 176 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 177 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 178 - DNA, 717 bp, Artificial Sequence
  source: /note="Description of Artificial Sequence: Synthetic polynucleotide"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 179 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 180 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 181 - protein, 483 aa, Artificial Sequence
  source: /note="Description of Artificial Sequence: Synthetic polypeptide"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 182 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 183 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 184 - DNA, 720 bp, Artificial Sequence
  source: /note="Description of Artificial Sequence: Synthetic polynucleotide"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 185 - protein, 115 aa, Artificial Sequence; identical to SEQ ID NO: 155
  source: /note="Description of Artificial Sequence: Synthetic polypeptide"

SEQ ID NO: 186 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 187 - protein, 484 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 188 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 189 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 190 - DNA, 723 bp, Artificial Sequence
  source: /note="Description of Artificial Sequence: Synthetic polynucleotide"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 191 - protein, 115 aa, Artificial Sequence; identical to SEQ ID NO: 95
  source: /note="Description of Artificial Sequence: Synthetic polypeptide"

SEQ ID NO: 192 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 193 - protein, 485 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 194 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 195 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 196 - DNA, 729 bp, Artificial Sequence
  source: /note="Description of Artificial Sequence: Synthetic polynucleotide"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 197 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 198 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 199 - protein, 487 aa, Artificial Sequence
  source: /note="Description of Artificial Sequence: Synthetic polypeptide"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 200 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 201 - protein, 244 aa, Artificial Sequence
  source: /note="Description of Artificial Sequence: Synthetic polypeptide"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 202 - DNA, 735 bp, Artificial Sequence
  source: /note="Description of Artificial Sequence: Synthetic polynucleotide"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 203 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 204 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 205 - protein, 489 aa, Artificial Sequence
  source: /note="Description of Artificial Sequence: Synthetic polypeptide"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 207 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 208 - DNA, 738 bp, Artificial Sequence
  source: /note="Description of Artificial Sequence: Synthetic polynucleotide"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 209 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 210 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 211 - protein, 490 aa, Artificial Sequence
  source: /note="Description of Artificial Sequence: Synthetic polypeptide"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 212 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 213 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 214 - DNA, 720 bp, Artificial Sequence
  source: /note="Description of Artificial Sequence: Synthetic polynucleotide"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 215 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 216 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 217 - protein, 484 aa, Artificial Sequence
  source: /note="Description of Artificial Sequence: Synthetic polypeptide"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 218 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 219 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 220 - DNA, 723 bp, Artificial Sequence
  source: /note="Description of Artificial Sequence: Synthetic polynucleotide"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 221 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 222 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 223 - protein, 485 aa, Artificial Sequence
  source: /note="Description of Artificial Sequence: Synthetic polypeptide"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 224 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 225 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 226 - DNA, 735 bp, Artificial Sequence
  source: /note="Description of Artificial Sequence: Synthetic polynucleotide"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 227 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 228 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 229 - protein, 489 aa, Artificial Sequence
  source: /note="Description of Artificial Sequence: Synthetic polypeptide"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 231 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 232 - DNA, 759 bp, Artificial Sequence
  source: /note="Description of Artificial Sequence: Synthetic polynucleotide"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 233 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 234 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 235 - protein, 497 aa, Artificial Sequence
  source: /note="Description of Artificial Sequence: Synthetic polypeptide"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 236 - DNA, 1491 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 237 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 238 - DNA, 744 bp, Artificial Sequence
  source: /note="Description of Artificial Sequence: Synthetic polynucleotide"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 239 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 240 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 241 - protein, 492 aa, Artificial Sequence
  source: /note="Description of Artificial Sequence: Synthetic polypeptide"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 242 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 243 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 244 - DNA, 738 bp, Artificial Sequence
  source: /note="Description of Artificial Sequence: Synthetic polynucleotide"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 245 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 246 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 247 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 248 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 249 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 250 - DNA, 723 bp, Artificial Sequence
  source: /note="Description of Artificial Sequence: Synthetic polynucleotide"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 251 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 252 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 253 - protein, 485 aa, Artificial Sequence
  source: /note="Description of Artificial Sequence: Synthetic polypeptide"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 254 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 255 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 256 - DNA, 744 bp, Artificial Sequence
  source: /note="Description of Artificial Sequence: Synthetic polynucleotide"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 257 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 258 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 259 - protein, 492 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 260 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 261 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 262 - DNA, 744 bp, Artificial Sequence
  source: /note="Description of Artificial Sequence: Synthetic polynucleotide"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 263 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 264 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 265 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 266 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 267 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 268 - DNA, 717 bp, Artificial Sequence
  source: /note="Description of Artificial Sequence: Synthetic polynucleotide"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 269 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 270 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 271 - protein, 483 aa, Artificial Sequence
  source: /note="Description of Artificial Sequence: Synthetic polypeptide"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 272 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 273 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 274 - DNA, 738 bp, Artificial Sequence
  source: /note="Description of Artificial Sequence: Synthetic polynucleotide"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 275 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 276 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 277 - protein, 490 aa, Artificial Sequence
  source: /note="Description of Artificial Sequence: Synthetic polypeptide"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 279 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 280 - DNA, 723 bp, Artificial Sequence
  source: /note="Description of Artificial Sequence: Synthetic polynucleotide"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 281 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 282 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 283 - protein, 485 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 284 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 285 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 286 - DNA, 726 bp, Artificial Sequence
  source: /note="Description of Artificial Sequence: Synthetic polynucleotide"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 287 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 288 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 289 - protein, 486 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 290 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 291 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 292 - DNA, 744 bp, Artificial Sequence
  source: /note="Description of Artificial Sequence: Synthetic polynucleotide"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 293 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 294 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 295 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 297 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 298 - DNA, 732 bp, Artificial Sequence
  source: /note="Description of Artificial Sequence: Synthetic polynucleotide"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 299 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 300 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 301 - protein, 488 aa, Artificial Sequence
  source: /note="Description of Artificial Sequence: Synthetic polypeptide"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 303 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 304 - DNA, 733 bp, Artificial Sequence
  source: /note="Description of Artificial Sequence: Synthetic polynucleotide"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 305 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 306 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 307 - protein, 488 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 308 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 309 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 310 - DNA, 753 bp, Artificial Sequence
  source: /note="Description of Artificial Sequence: Synthetic polynucleotide"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 311 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 312 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 313 - protein, 495 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 314 - DNA, 1485 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 315 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 316 - DNA, 739 bp, Artificial Sequence
  source: /note="Description of Artificial Sequence: Synthetic polynucleotide"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 317 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 318 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 319 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 320 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 321 - protein, 122 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 322 - protein, 107 aa, Artificial Sequence
  source: /note="Description of Artificial Sequence: Synthetic polypeptide"
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 323 - protein, 244 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 324 - protein, 467 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - protein, 117 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 326 - protein, 111 aa, Artificial Sequence
  source: /note="Description of Artificial Sequence: Synthetic polypeptide"
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 327 - protein, 249 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 328 - protein, 472 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 329 - protein, 117 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 330 - protein, 111 aa, Artificial Sequence
  source: /note="Description of Artificial Sequence: Synthetic polypeptide"
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 331 - protein, 243 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 332 - protein, 466 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 333 - protein, 117 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 334 - protein, 111 aa, Artificial Sequence; identical to SEQ ID NO: 330
  source: /note="Description of Artificial Sequence: Synthetic polypeptide"

SEQ ID NO: 335 - protein, 243 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 336 - protein, 466 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 337 - protein, 4 aa, Artificial Sequence
  source: /note="Description of Artificial Sequence: Synthetic peptide"
RGDS

SEQ ID NO: 338 - protein, 244 aa, Artificial Sequence; identical to SEQ ID NO: 86
  source: /note="Description of Artificial Sequence: Synthetic polypeptide"

SEQ ID NO: 339 - protein, 464 aa, Artificial Sequence; identical to SEQ ID NO: 87
  source: /note="Description of Artificial Sequence: Synthetic polypeptide"

SEQ ID NO: 340 - protein, 246 aa, Artificial Sequence; identical to SEQ ID NO: 88
  source: /note="Description of Artificial Sequence: Synthetic polypeptide"

SEQ ID NO: 341 - protein, 439 aa, Artificial Sequence; identical to SEQ ID NO: 89
  source: /note="Description of Artificial Sequence: Synthetic polypeptide"

What is claimed is:

1. A method for treating a subject having a cancer, comprising:
   administering to the subject a therapeutically effective dose of a CAR-expressing cell therapy, and
   measuring the level or activity of soluble gp130 (sgp130) in a sample from the subject to determine a cytokine release syndrome (CRS) risk status comprising a measure of the level or activity of sgp130, wherein the CRS risk status is indicative of the subject's risk for developing CRS, wherein the subject is identified as being at risk of developing CRS if the level or activity of sgp130 is greater than a reference level or activity; and
   responsive to a determination of the CRS risk status,
   administering to the subject a second therapy comprising one or more of: an IL6 inhibitor, a vasoactive medication, an immunosuppressive agent, a corticosteroid, or mechanical ventilation if the level or activity of sgp130 is greater than the reference level or activity.

2. The method of claim 1, wherein said CRS risk status further comprises a measure of the level or activity of IL6 receptor (IL6R) or soluble IL6 receptor (sIL6R).

3. The method of claim 1, wherein:
   (i) the CRS risk status is indicative of whether the subject is at high risk or low risk of developing severe CRS;
   (ii) the CRS is of clinical grade 1-5;
   (iii) the CRS is severe CRS; or
   (iv) the CRS is severe CRS of clinical grade 4-5.

4. The method of claim 3, wherein said measure of CRS risk status further comprises a measure of one, two, three, four, five, six, seven, eight, nine, ten, or all of the following:
   (i) the level or activity of sgp130 or interferon-gamma (IFN-g), or a combination thereof;
   (ii) the level or activity of sgp130, IFN-gamma, or IL1Ra, or a combination thereof;
   (iii) the level or activity of sgp130, IFN-gamma, or MIP1-alpha, or a combination thereof;
   (iv) the level or activity of sgp130, MCP1, or eotaxin, or a combination thereof;
   (v) the level or activity of IL2, eotaxin, or sgp130, or a combination thereof;
   (vi) the level or activity of IFN-gamma, IL2, or eotaxin, or a combination thereof;
   (vii) the level or activity of IL10, or the level of disease burden in the subject, or a combination thereof;
   (viii) the level or activity of IFN-gamma or IL-13, or a combination thereof;
   (ix) the level or activity of IFN-gamma, IL-13, or MIP1-alpha, or a combination thereof;
   (x) the level or activity of IFN-gamma or MIP1-alpha, or a combination thereof;
   (xi) the level or activity of IFN-gamma, IL6, sIL6R or sgp130, or a combination thereof.

5. The method of claim 4, wherein the subject at high risk of severe CRS is identified as having:
   a greater level or activity of sgp130 and a greater level or activity of IFN-gamma;
   a greater level or activity of sgp130 and a lower level or activity of IL1Ra;
   a greater level or activity of IFN-gamma and a lower level or activity of IL1Ra;
   a greater level or activity of sgp130, a greater level or activity of IFN-gamma, and a lower level or activity of IL1Ra;
   a greater level or activity of sgp130 and bone marrow disease;
   a greater level or activity of IFN gamma and bone marrow disease; or
   a greater level or activity of sgp130, IFN gamma and bone marrow disease,
   compared to a reference sample from a subject at low risk of severe CRS or a control level or activity.

6. The method of claim 4, wherein the subject at high risk of severe CRS is identified as having:
   a greater level or activity of sgp130 and a lower level or activity of MIP1-alpha;
   a greater level or activity of IFN-gamma and a lower level or activity of M1P1-alpha;
   a greater level or activity of sgp130, a greater level or activity of IFN-gamma, and a lower level or activity of MIP1-alpha;
   a greater level or activity of sgp130 and a greater level or activity of MCP1;
   a greater level or activity of sgp130 and a lower level or activity of eotaxin;
   a greater level or activity of MCP1 and a lower level or activity of eotaxin; or
   a greater level or activity of sgp130, a greater level or activity of MCP1, and a lower level or activity of eotaxin;
   compared to a reference sample from a subject at low risk of severe CRS or compared to a control level or activity.

7. The method of claim 4, wherein the subject at high risk of severe CRS is identified as having:
- a greater level or activity of IL-2 and a lower level or activity of eotaxin;
- a greater level or activity of IL-2 and a greater level or activity of sgp130;
- a lower level or activity of eotaxin and a greater level or activity of sgp130;
- a greater level or activity of IL-2, a lower level or activity of eotaxin, and a greater level or activity of sgp130;
- a greater level or activity of IFN-gamma and a greater level or activity of IL-2;
- a greater level or activity of IFN-gamma and a lower level or activity of eotaxin; or
- a greater level or activity of IFN-gamma, a greater level or activity of IL-2, and a lower level or activity of eotaxin,
- compared to a reference sample from a subject at low risk of severe CRS or compared to a control level or activity.

8. The method of claim 3, further comprising the step of selecting a CAR-expressing cell therapy for the subject, based on the CRS risk status acquired, wherein:
   (i) the CRS risk status acquired is that the subject is at high risk of severe CRS, and the therapy suggested is a subsequent dose of CAR-expressing cells that is at a lower dose than the previous dose of CAR-expressing cell therapy administered to the subject; or
   (ii) the CRS risk status acquired is that the subject is at high risk of severe CRS, and the therapy suggested is a subsequent dose of CAR-expressing cells that comprises a different CAR or different cell type than the previous CAR-expressing cell therapy administered to the subject.

9. The method of claim 1 wherein the method is performed on a subject that does not have:
   (i) a symptom of CRS;
   (ii) a symptom of severe CRS;
   (iii) low blood pressure or a fever; or
   (iv) grade 4 organ toxicity or a need for mechanical ventilation.

10. The method of claim 1, wherein the reference level or activity is from a subject at low risk of severe CRS or a healthy subject.

11. The method of claim 1, wherein said CRS risk status further comprises a measure of the level or activity of IL6.

12. The method of claim 11, wherein the level or activity of IL6 and/or sgp130 is at least 2, 3, 4, 5, 6, 7, 8, 9, 10, 15, 20, 25, 30, 40, 50, 100, 500, 1000-fold or more greater, relative to the reference level or activity.

13. The method of claim 1, wherein the measure of sgp130 evaluates the mRNA level or protein level.

14. The method of claim 1, further comprising acquiring a measure of the level or activity of one, two, three, four, five, ten, twenty or more of a cytokine or cytokine receptor chosen from sTNFR2, IP10, sIL1R2, sTNFR1, MIG, VEGF, sILR1, TNFα, IFNα, GCSF, sRAGE, IL4, IL10, IL1R1, IFN-γ, IL8, sIL2Ra, sgp130, MCP1, MIP1α, M1β, or GM-CSF, or a combination thereof.

15. The method of claim 1, further comprising determining the level of C-reactive protein (CRP) in a sample from the subject, wherein:
   (i) a subject at low risk of severe CRS is identified as having a CRP level of less than 7 mg/dL; or
   (ii) a subject high risk of severe CRS is identified as having a greater level of CRP in a sample compared to a subject at low risk of severe CRS or compared to a control level or activity.

16. The method claim 1, wherein the CAR-expressing cell therapy comprises a plurality of CAR19-expressing immune effector cells.

17. The method of claim 1, wherein if the subject is identified as being at risk for severe CRS and is identified as being sensitive to an IL6 receptor inhibitor, the second therapy comprises an IL6 receptor inhibitor.

18. The method of claim 1, wherein the sample comprises a blood sample, a plasma sample or a serum sample.

19. The method of claim 1, wherein the subject is an adult or a pediatric subject.

20. The method of claim 1, wherein the cancer is a hematological cancer.

21. The method of claim 20, wherein the hematological cancer is associated with CD19 expression.

22. The method of claim 1, wherein the cancer is chosen from B-cell acute lymphoblastic leukemia (B-ALL), T-cell acute lymphoblastic leukemia (T-ALL), acute lymphoblastic leukemia (ALL), chronic myelogenous leukemia (CML), chronic lymphocytic leukemia (CLL), B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, or Waldenstrom macroglobulinemia.

23. The method of claim 1, wherein:
   (i) the sample from the subject is evaluated while receiving the CAR-expressing cell therapy or after receiving the CAR-expressing cell therapy;
   (ii) the sample from the subject is evaluated 10 days or less after infusion with the CAR-expressing cell therapy; and/or
   (iii) wherein the subject is a human.

24. The method of claim 1, further comprising one, two, or all of administering to the subject an altered dosing of the CAR-expressing cell therapy, altering the schedule or time course of the CAR-expressing cell therapy, or administering to the subject an alternative therapy.

25. The method of claim 1, wherein the second therapy comprises the IL6 inhibitor, and wherein the IL6 inhibitor is tocilizumab.

* * * * *

UNITED STATES PATENT AND TRADEMARK OFFICE
CERTIFICATE OF CORRECTION

PATENT NO. : 11,747,346 B2  
APPLICATION NO. : 15/757123  
DATED : September 5, 2023  
INVENTOR(S) : Garfall et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 375 days.

In the Claims

At Column 268, Claim number 6, Line number 52, delete "M1P1-alpha" and insert --MIP1-alpha--.

At Column 270, Claim number 14, Line number 1, delete "sIL2Ra" and insert --sIL2Rα--.

At Column 270, Claim number 15, Line number 8, delete "(ii) a subject high risk of severe CRS" and insert --(ii) a subject at high risk of severe CRS--.

Signed and Sealed this  
Eighteenth Day of February, 2025

Coke Morgan Stewart  
*Acting Director of the United States Patent and Trademark Office*